(12) United States Patent
Taylor et al.

(10) Patent No.: US 9,889,165 B2
(45) Date of Patent: Feb. 13, 2018

(54) COMPOSITIONS AND METHODS FOR TREATMENT OF SKIN DISORDERS

(71) Applicant: NAKED BIOME, INC., San Francisco, CA (US)

(72) Inventors: Emma Taylor, San Francisco, CA (US); David Hanzel, Palo Alto, CA (US)

(73) Assignee: NAKED BIOME, INC., San Francisco, CA (US)

( * ) Notice: Subject to any disclaimer, the term of this patent is extended or adjusted under 35 U.S.C. 154(b) by 0 days.

(21) Appl. No.: 15/493,971

(22) Filed: Apr. 21, 2017

(65) Prior Publication Data
US 2017/0304373 A1 Oct. 26, 2017

Related U.S. Application Data

(60) Provisional application No. 62/325,851, filed on Apr. 21, 2016, provisional application No. 62/368,829, filed on Jul. 29, 2016, provisional application No. 62/368,837, filed on Jul. 29, 2016, provisional application No. 62/385,831, filed on Sep. 9, 2016, provisional application No. 62/441,931, filed on Jan. 3, 2017.

(51) Int. Cl.
*A61K 35/741* (2015.01)
(52) U.S. Cl.
CPC .................. *A61K 35/741* (2013.01)
(58) Field of Classification Search
CPC .................................................. A61K 35/741
See application file for complete search history.

(56) References Cited

U.S. PATENT DOCUMENTS

| 7,781,410 B2 | 8/2010 | Saliou et al. |
| 9,549,905 B2 | 1/2017 | Taylor et al. |
| 2006/0121015 A1 | 6/2006 | Collins et al. |
| 2008/0032938 A1 | 2/2008 | Saliou et al. |
| 2008/0206155 A1 | 8/2008 | Tamarkin et al. |
| 2008/0229609 A1 | 9/2008 | Bronshtein et al. |
| 2009/0005439 A1 | 1/2009 | Faryniarz et al. |
| 2009/0035329 A1 | 2/2009 | Blaser et al. |
| 2009/0093440 A1 | 4/2009 | Murad |

(Continued)

FOREIGN PATENT DOCUMENTS

| CN | 101500551 A | 8/2009 |
| CN | 104364394 A | 2/2015 |

(Continued)

OTHER PUBLICATIONS

Kasimatis et al., "Analysis of complete genomes of Propionibacterium acnes reveals a novel plasmid and increased pseudogenes in an acne associated strain," BioMed Research International, article ID No. 918320, 2013.*

(Continued)

*Primary Examiner* — Rosanne Kosson
(74) *Attorney, Agent, or Firm* — Wilson Sonsini Goodrich & Rosati

(57) ABSTRACT

Described herein are compositions and methods of treatment for acne and other skin disorders involving the use of probiotics. In certain aspects, microbes included in the probiotics have been engineered or selected for the treatment of specific skin disorders.

18 Claims, 9 Drawing Sheets

(56) References Cited

U.S. PATENT DOCUMENTS

| | | |
|---|---|---|
| 2010/0310680 A1 | 12/2010 | Chen et al. |
| 2015/0086581 A1 | 3/2015 | Li et al. |

FOREIGN PATENT DOCUMENTS

| | | | |
|---|---|---|---|
| EP | 1789529 A2 | 5/2007 | |
| EP | 2825676 A1 | 1/2015 | |
| JP | 2015512255 A | 4/2015 | |
| KR | 20020085307 A | 11/2002 | |
| WO | WO-0181581 A2 | 11/2001 | |
| WO | WO-03033515 A1 | 4/2003 | |
| WO | WO-2006018446 A2 | 2/2006 | |
| WO | WO-2007056680 A2 | 5/2007 | |
| WO | WO-2007110883 A1 | 10/2007 | |
| WO | WO-2008019212 A2 | 2/2008 | |
| WO | WO-2009105592 A2 | 8/2009 | |
| WO | WO-2010065735 A2 | 6/2010 | |
| WO | WO-2011039175 A1 | 4/2011 | |
| WO | WO-2012129499 A1 | 9/2012 | |
| WO | WO-2013142378 A1 | 9/2013 | |
| WO | WO-2015160911 A2 | 10/2015 | |
| WO | WO-2015171899 A1 | 11/2015 | |

OTHER PUBLICATIONS

McDowell et al., "A new phylogenetic group of Propionibacterium acnes," J Med Microbiol 57, 218-224, 2008.*

Altschul et al., Basic local alignment search tool. J. Mol. Biol. 215:403-410, 1990.

Arrach et al., Salmonella promoters preferentially activated inside tumors. Cancer Res, 68:4827-4832, 2008.

Ashkenazi et al., Eradication of Propionibacterium acnes by its endogenous porphyrins after illumination with high intensity blue light. FEMS Immunology and Medical Microbiology, 35:17-24, 2003.

Balskus and Walsh, The genetic and molecular basis for sunscreen biosynthesis in Cyanobacteria. Science, 329:1653, 2010.

Barnard et al., The balance of metagenomic elements shapes the skin microbiome in acne and health. Scientific Reports, 6:39431, 12 pages, published Dec. 21, 2016.

Bates and Gilbert, Characterization of a cryptic plasmid from Lactobacillus plantarum. Gene, 85:253-258, 1989.

Behnsen et al., Probiotics: Properties, examples, and specific applications. Cold Spring Harbor Laboratory Press, 3:a010074 (21 pages), 2013.

Bi and Lai, Bacterial chemoreceptors and chemoeffectors. Cellular and Molecular Life Sciences, 72:691-708, 2015.

Bichsel et al., Bacterial delivery of nuclear proteins into pluripotent and differentiated cells. PLoS ONE, 6:e16465, 2011.

Bichsel et al., Direct reprogramming of fibroblasts to myocytes via bacterial injection of MyoD protein. Cell Reprogram, 15:117-125, 2013.

Bik et al., Bacterial diversity in the oral cavity of 10 healthy individuals. The ISME Journal, 4(8):962-974, 2010.

Blanco-Toribio et al., Direct injection of functional single-domain antibodies from E. coli into human cells. PLoS ONE, 5:e15227, 2010.

Borrero et al., Modified lactic acid bacteria detect and inhibit multiresistant enterococci. ACS Synth Biol, 4:299-306, 2015.

Bouia et al., Structural organization of pLP1, a cryptic plasmid from Lactobacillus plantarum CCM1904. Plasmid, 22(3):185-192, 1989.

Braat et al., A phase I trial with transgenic bacteria expressing interleukin-10 in Crohn's disease. Clin Gastroenterol Hepatol 4:754-759, 2006.

Brzuszkiewicz et al., Comparative genomics and transcriptions of Propionibacterium Acnes. PLoS ONE, 6(6):e21581, 2011.

Caluwaerts et al., AG013, a mouth rinse formulation of Lactococcus lactis secreting human Trefoil Factor 1, provides a safe and efficacious therapeutic tool for treating oral mucositis. Oral Oncology, 46:564-570, 2010.

Cameron et al., A brief history of synthetic biology. Nat Rev Microbiol 12:381-390, 2014.

Chakraborty et al., Analysis of the human oral microbiome of smokers and non-smokers using PCR-RFLP and bibotyping. Advances in Microbiology, 4:681-691, 2014.

Chen et al., Identifying Chinese herbal medicine network for treating acne: Implications from a nationwide database. Journal of Ethnopharmacology, 179:1-8, 2016.

Chen et al., Incorporation of therapeutically modified bacteria into gut microbiota inhibits obesity. J Clin Invest 124:3391-3406, 2014.

Chen et al., Probiotic Lactobacillus casei expressing human lactoferrin elevates antibacterial activity in the gastrointestinal tract. Biometals, 23:543-554, 2010.

Colaco et al., Heat shock proteins: stimulators of innate and acquired immunity. Biomed Res Int, 2013:461230, 2013.

Csorgo et al., Low-mutation- rate, reduced-genome Escherichia coli: an improved host for faithful maintenance of engineered genetic constructs. Microb Cell Fact, 11:11, 2012.

Dai et al., Construction of an inducible cell-communication system that amplifies Salmonella gene expression in tumor tissue. Biotechnol Bioeng, 110:1769-1781, 2013.

Danielsen, M., Characterization of the tetracycline resistance plasmid pMD5057 from Lactobacillus plantarum 5057 reveals a composite structure. Plasmid, 48:98-103, 2002.

de las Rivas et al., Complete nucleotide sequence and structural organization of pPB1, a small Lactobacillus plantarum cryptic plasmid that originated by modular exchange. Plasmid, 52:203-211, 2004.

De Vos and Simons, Molecular cloning of lactose genes in dairy lactic streptococci: the phospho-beta-galactosidase and beta-galactosidase genes and their expression products. Biochimie, 70:461-473, 1988.

Dekio et al., Genetic diversity of Propionibacterium acnes strains isolated from human skin in Japan and comparison with their distribution in Europe. Journal of Medical Microbiology, 61:622-630, 2012.

Docherty et al., Resveratrol inhibition of propionibacterium acnes (abstract). J.Antimicrob. Chemother., 59(6): 1182-1184, 2007.

Duan et al., Engineered commensal bacteria reprogram intestinal cells into glucose-responsive insulin-secreting cells for the treatment of diabetes. Diabetes, 64:1794-1803, 2015.

Eady et al., Propionibacterium acnes resistance: A worldwide problem. Dermatology, 206:54-56, 2003.

Elliott and Geiduschek, Defining a bacteriophage T4 late promoter: Absence of a "-35" region. Cell, 36:211-219, 1984.

Fan et al., Effects of 420-nm intense pulsed light in an acne animal model. Journal of the European Academy of Dermatology and Venereology, 27(9):1168-1171, 2013.

Farrar et al., Genome sequence and analysis of a Propionibacterium acnes bacteriophage. J. Bacteriol., 189:4161-4167, 2007.

Farris, Idebenone, green tea, and coffeeberry extract: new and innovative antioxidants. Dermatol. Ther., 20(5):322-329, 2007.

Farzadfard et al., Synthetic biology. Genomically encoded analog memory with precise in vivo DNA writing in living cell populations. Science, 346:1256-272, 2014.

Feuerstein et al., Mechanism of visible light phototoxicity on Porphyromonas gingivalis and Fusobacterium nucleatum. Photochemistry and Photobiology, 81(5):1186-1189, 2005.

Fitz-gibbon et al., Propionibacterium acnes strain populations in the human skin microbiome associated with acne. J.Invest.Dermatology, 133(9):2152-2160, 2013.

Forbes. Engineering the perfect (bacterial) cancer therapy. Nat Rev Cancer, 10:785-794, 2010.

Forbes et al., Sparse initial entrapment of systemically injected Salmonella typhimurium leads to heterogeneous accumulation within tumors. Cancer Res, 63:5188-5193, 2003.

Galan et al., Bacterial type III secretion systems: specialized nanomachines for protein delivery into target cells. Annu Rev Microbiol, 68:415-438, 2014.

Ganai et al., Tumour-targeted delivery of TRAIL using Salmonella typhimurium enhances breast cancer survival in mice. Br J Cancer, 101:1683-1691, 2009.

(56) References Cited

OTHER PUBLICATIONS

Gandhi et al., Bacillus Calmette-Guerin immunotherapy for genitourinary cancer. BJU Int, 112:288-297, 2013.
Gaudu et al., Respiration capacity and consequences in Lactococcus lactis, 82:263-269, 2002.
Goh et al., Engineering commensal bacteria for prophylaxis against infection. Curr Opin Biotechnol, 23:924-930, 2012.
Gold et al., Clinical efficacy of self-applied blue light therapy for mild-to-moderate facial acne. J Clin Aesthetic Dermatol, 2(3):44-50, 2009.
Goodfellow et al., Oral spironolactone improves acne vulgars and reduces sebum excretion (abstract). Br. J. Dermatol., 111(2):209-214, 1984.
Green et al., Toehold switches: de- novo-designed regulators of gene expression. Cell, 159:925-939, 2014.
Grice et al., Topographical and temporal diversity of the human skin microbiome. SCIENCE, 324(5931):1190-1192, 2009.
Gruss et al., Functional analysis of a palindromic sequence required for normal replication of several staphylococcal plasmids. Proc. Nat. Acad. Sci. USA, 84:2165-2169, 1987.
Hassoun and Sivamani, A systematic review of lactoferrin use in dermatology. Critical reviews in food science and nutrition, 29 pages, 2016. DOI:1 0.1080/10408398.2015.1137859.
Hillman et al., Construction and characterization of an effector strain of *Streptococcus mutans* for replacement therapy of dental caries. Infect Immun, 68:543-549, 2000.
Hockberger et al., Activation of flavin-containing oxidases underlies light-induced production of H2O2 in mammalian cells. Proc Natl Acad Sci USA, 96:6255-6260, 1999.
Horinouchi & Weisblum, Nucleotide sequence and functional map of pEl 94, a plasmid that specifies inducible resistance to macrolide, lincosamide, and streptogramin Type B antibodies. Journal of Bacteriology, 150(2):804-814, 1982.
Huh et al., Modular design of a synthetic payload delivery device. ACS Synth Biol, 2:418-424, 2013.
Huibregtse et al., Genetically Modified Lactococcus lactis for Delivery of Human Interleukin-10 to Dendritic Cells. Gastroenterol Res Pract, 2012:639291, 2012.
Huibregtse et al., Induction of antigen- specific tolerance by oral administration of Lactococcus lactis delivered immunodominant DQ8-restricted gliadin peptide in sensitized nonobese diabetic Abo Dq8 transgenic mice. J Immunol , 183:2390-2396, 2009.
Huibregtse et al., Induction of ovalbumin-specific tolerance by oral administration of Lactococcus lactis secreting ovalbumin. Gastroenterology, 133:517-528, 2007.
Hurwitz et al., Antimicrobial peptide delivery strategies: use of recombinant antimicrobial peptides in paratransgenic control systems. Curr Drug Targets, 13:1173-1180, 2012.
Hwang et al., Reprogramming microbes to be pathogen-seeking killers. ACS Synth Biol, 3:228-237, 2014.
Jia et al., Bacterial delivery of TALEN proteins for human genome editing. PLoS ONE, 9:e91547, 2014.
Jiang et al., Inhibition of tumor growth and metastasis by a combination of *Escherichia coli*-mediated cytolytic therapy and radiotherapy. Mol Ther, 18:635-642, 2010.
Jing et al., Oral administration of Lactococcus lactis delivered heat shock protein 65 attenuates atherosclerosis in low-density lipoprotein receptor-deficient mice. Vaccine, 29:4102-4109, 2011.
Johnson et al., Strain-level differences in porphyrin production and regulation in Propionibacterium acnes elucidate disease associations. mSphere 1(1):e00023-15, 2016.
Johnson et al., Strain-level differences in porphyrin production and regulation in Propionibacterium acnes elucidate disease associations. Molecular Biology and Physiology, 1(1):1-12, 2016.
Johnson et al., Use of systemic agents in the treatment of acne vulgaris. Am. Fam. Physician, 62(8):1823-1830, 2000.
Josson et al., Lactobacillus hilgardii plasmid pLAB1000 consists of two functional cassettes commonly found in other gram-positive organisms. Journal of Bacteriology, 172(6):3089-3099, 1990.

Kahn and Novick, Structural analysis of plasmid pSN2 in *Staphylococcus aureus*: No involvement in Enterotoxin B production. Journal of Bacteriology, 149(2):642-649, 1982.
Kaji et al., Virus-free induction of pluripotency and subsequent excision of reprogramming factors. Nature , 458:771-775, 2009.
Karlin and Altschul, Applications and statistics for multiple high-scoring segments in molecular sequences. Proc. Natl. Acad. Sci. USA 90:5873-5877, 1993.
Karlin and Altschul, Methods for assessing the statistical significance of molecular sequence features by using general scoring schemes. Proc. Natl. Acad. Sci. USA 87:2264-2268, 1990.
Kasimatis et al., Analysis of complete genomes of Propionibacterium acnes reveals a novel plasmid and increased pseudogenes in an acne associated strain. BioMed Research International, vol. 2013, Article ID 918320, 11 pages, 2013.
Kawada et al., Acne phototherapy with a high-intensity, enhanced, narrow-band, blue light source: an open study and in vitro investigation. Journal of Dermatological Science, 30(2):129-135, 2002.
Kiatpapan and Murooka, Genetic manipulation system in Propionibacteria. Journal of Bioscience and Bioengineering, 93(1):1-8, 2002.
Kim and Mills, Improvement of a nisin-inducible expression vector for use in lactic acid bacteria. Plasmid, 58:275-283, 2007.
Kim et al., A xylose-inducible Bacillus Subtilis integration vector and its application. Gene, 181(1-2):71-76, 1996.
Kleinpenning et al., Clinical and histological effects of blue light on normal skin. Photodermatol Photoimmunol Photomed, 26(1):16-21, 2010.
Koepsel and Khan, Cleavage of single-stranded DNA by plasmid pT181-encoded RepC protein. Nucleic Acids Research, 15(10):4085-4097, 1987.
Kolar et al., Group B *Streptococcus* evades host immunity by degrading hyaluronan. Cell Host & Microbe, 18:694-704, 2015.
Korting et al., Influence of the regular use of a soap or an acidic syndet bar on pre-acne. Infection, 23:89-93, 1995.
Kotula et al., Programmable bacteria detect and record an environmental signal in the mammalian gut. Proc Natl Acad Sci U S A 111:4838-4843, 2014.
Lagenaur et al., Prevention of vaginal SHIV transmission in macaques by a live recombinant Lactobacillus. Mucosal Immunol, 4:648-657, 2011.
Leer et al., Structural and functional analysis of two cryptic plasmids from Lactobacillus pentosus MD353 and Lactobacillus plantarum ATCC 8014. Mol Gen Genet, 234(2):265-274, 1992.
Lehouritis et al., Bacterial-directed enzyme prodrug therapy. J Control Release, 170:120-131, 2013.
Ley et al., Obesity alters gut microbial ecology. Proc Natl Acad Sci U S A, 102:11070-11075, 2005.
Li et al., Glutathione protects Lactococcus lactis against oxidative stress. Applied and Environmental Microbiology, 69(10):5739-5745, 2003.
Limaye et al., Phase 1 b, multicenter, single blinded, placebo-controlled, sequential dose escalation study to assess the safety and tolerability of topically applied AG013 in subjects with locally advanced head and neck cancer receiving induction chemotherapy. Cancer, 119:4268-4276, 2013.
Liu et al., The diversity and host interactions of Propionibacterium acnes bacteriophages on human skin. ISME Journal, 9:2078-2093, 2015.
Loessner et al., Drug-inducible remote control of gene expression by probiotic *Escherichia coli* Nissle 1917 in intestine, tumor and gall bladder of mice. Microbes Infect, 11:1097-1105, 2009.
Lomholt et al., Population genetic analysis of propionibacterium acnes identifies a subpopulation and epidemic clones associated with acne. PLoS ONE, 5(8):e12277, 2010.
Luchansky, Molecular cloning and deoxyribonucleic acid polymorphisms in Lactobacillus acidophilus and Lactobacillus gesseri. J. Dairy Sci. 74:3293-3302, 1991.
Maclean et al., The role of oxygen in the visible light inactivation of *Staphylococcus aureus*. Journal of Photochemistry and Photobiology B: Biology, 92(3):180-184, 2008.

(56) References Cited

OTHER PUBLICATIONS

MacNeal, Robert J. Dermatologic Disorders, Chapter 71, Approach to the Dermatologic Patient. In: The Merck Manual of Diagnosis and Therapy, 19th edition, Whitehouse Station, NJ: Merck Sharp & Dohme Corp., p. 632-644, 2011.
Maeda. The link between infection and cancer: tumor vasculature, free radicals, and drug delivery to tumors via the EPR effect. Cancer Sci, 104:779-789, 2013.
Mandell et al., Biocontainment of genetically modified organisms by synthetic protein design. Nature, 518:55-60, 2015.
Marinelli et al., Propionibacterium acnes bacteriophages display limited genetic diversity and broad killing activity against bacterial skin isolates. MBio., 3(5):1-13 (2012).
Marliere et al., Chemical evolution of a bacterium's genome. Angew Chem Int Ed Engl, 50:7109-7114, 2011.
Martin et al., Role of commensal and probiotic bacteria in human health: a focus on inflammatory bowel disease. Microb Cell Fact, 12:71, 2013.
McDowell et al., A novel multiocus sequence typing scheme for the opportunistic pathogen propionibacterium acnes and characterization of Type 1 cell surface-associated antigens. Microbiology, 157:1990-2003, 2011.
McDowell et al., An expended multilocus sequence typing scheme for propionibacterium acnes: Investigation of 'pathogenic', 'commensal' and antibiotic resistant strains. PLoS One, 7(7):e41480 (2012).
McDowell et al., Proposal to reclassify Propionibacterium acnes type 1 as *Propionibacterium acnes* subsp. *acnes* subsp. nov. and Propionibacterium acnes type 11 as *Propionibacterium acnes* subsp. *defendens* subsp. nov. International Journal of Systematic and Evolutionary Microbiology, 66:5358-5365, 2016.
McDowell et al., The Opportunistic pathogen propionibacterium acnes: Insights into typing, human disease, clonal diversification and Camp factor evolution. PLoS ONE 8(9): e70897, 2013.
McInturff et al., Granulysin-derived peptides demonstrate antimicrobial and anti-inflammatory effects against propionibacterium acnes. J.Invest.Dermatol., 125(2):256-263, 2005.
Mengesha et al., Development of a flexible and potent hypoxia-inducible promoter for tumor-targeted gene expression in attenuated *Salmonella*. Cancer Biol Ther, 5:1120-1128, 2006.
Mierau and Kleerebezem, 10 years of the nisin-controlled gene expression system (NICE) in Lactococcus lactis. Applied Microbiology Biotechnology, 68:705-717, 2005.
Morton et al., An open study to determine the efficacy of blue light in the treatment of mild to moderate acne. Journal of Dermatological Treatment, 16(4):219-223, 2005.
Muyldermans. Nanobodies: natural single-domain antibodies. Annu Rev Biochem, 82:775-797, 2013.
Nakatsuji et al., Antimicrobial property of lauric acid against propionibacterium acnes: Its therapeutic potential for inflammatory acne vulgaria. J. Invest. Dermatol., 129:2480-2488, 2009.
Nakatsuji et al., Antimicrobials from human skin commensal bacteria protect against *Staphylococcus aureus* and are deficient in atopic dermatitis. Science Translational Medicine, 9:eaah4680, 51 pages (with supplemental materials), 2017.
Nakatsuji et al., Antobodies elicited by inactivated propionibacterium acnes-based vaccines exert protective immunity and attenuate the IL-8 production in human sebocytes: Relevance to therapy for acne vulgaris. J.Invest.Dermatol., 128(10):2451-2457, 2008.
NCBI, Genbank Accession No. AB097215.1, Propionibacterium acnes gene for 16S ribosomal RNA, complete sequence, 1 page, Dec. 3, 2002.
Nguyen et al., A food-grade system for inducible gene expression in Lactobacillus plantarum using an alanine racemase-encoding selection marker. Journal of Agricultural and Food Chemistry, 59:5617-5624, 2011.
Noborio et al., A new targeted blue light phototherapy for the treatment of acne. Photodermatology, Photoimmunology & Photomedicine, 23(1):32-34, 2007.

Nouaille et al., Heterologous protein production and delivery systems for Lactococcus lactis. Genet Mol Res, 2(1):102-111, 2003.
Omi et al., 420 nm intense continuous light therapy for acne. Journal of Cosmetic and Laser Therapy, 6(3):156-162, 2009.
Pan et al., In vitro activities of three synthetic peptides derived from epinecidin-1 and an anti-lipopolysaccharide factor against Propionibacterium acnes, Candida albicans, and Trichomonas vaginalis. Peptides, 30:1058-1068, 2009.
Pant et al., Lactobacilli expressing variable domain of Llama heavy-chain antibody fragments (Lactobodies) confer protection against rotavirus-induced diarrhea. J Infect Dis, 194:1580-1588, 2006.
Panthel et al., Salmonella type III-mediated heterologous antigen delivery: a versatile oral vaccination strategy to induce cellular immunity against infectious agents and tumors. Int J Med Microbiol, 298:99-103, 2008.
Papapetrou et al., Stoichiometric and temporal requirements of Oct4, Sox2, Klf4, and c-Myc expression for efficient human iPSC induction and differentiation. Proc Natl Acad Sci U S A, 106:12759-12764, 2009.
Pawelek et al., Bacteria as tumour-targeting vectors. Lancet Oncol, 4:548-556, 2003.
PCT/US2012/030335 International Preliminary Report on Patentability dated Sep. 24, 2013.
PCT/US2012/030335 International Search Report dated Aug. 16, 2012.
PCT/US2012/030335 Written Opinion dated Aug. 16, 2012.
PCT/US2013/032551 International Search report dated Jul. 12, 2013.
Pei et al., Light-based therapies in acne treatment. Indian Dermatology Online Journal, 6(3):145-157, 2015.
Perez-Arellano et al., Construction of compatible wide-host-range shuttle vectors for lactic acid bacteria and *Escherichia coli*. Plasmid, 46:106-116, 2001.
Pinero-Lambea et al., Engineered bacteria as therapeutic agents. Current Opinion in Biotechnology, 35:94-102, 2015.
Pinero-Lambea et al., Programming controlled adhesion of *E. coli* to target surfaces, cells, and tumors with synthetic adhesins. ACS Synth Biol, 4:463-473, 2015.
Pouwels et al., Genetics of lactobacilli: plasmids and gene expression, Antonie van Leeuwenhoek 64:85-107, 1993.
Rezende et al., Hsp65-producing Lactococcus lactis prevents experimental autoimmune encephalomyelitis in mice by inducing CD4+ LAP+ regulatory T cells. J Autoimmun, 40:45-57, 2013.
Ridaura et al., Gut microbiota from twins discordant for obesity modulate metabolism in mice. Science, 341(6150):22 pages, 2013.
Robert et al., Oral delivery of glutamic acid decarboxylase (GAD)-65 and IL10 by Lactococcus lactis reverses diabetes in recent-onset NOD mice. Diabetes, 63:2876-2887, 2014.
Ross et al., Phenotypic and genotypic characterization of antibiotic-resistant Propionibacterium acnes isolated from acne patients attending dermatology clinics in Europe, the U.S.A., Japan and Australia. The Journal of Dermatology, 144:339-346, 2001.
Royo et al., In vivo gene regulation in *Salmonella* spp. by a salicylate-dependent control circuit. Nat Methods, 4:937-942, 2007.
Rud et al., A synthetic promoter library for constitutive gene expression in Lactobacillus plantarum. Microbiology, 152:1011-1019, 2006.
Russo, E., Learning how to manipulate DNA's double helix has fuelled job growth in biotechnology during the past 50 years. Nature, 421(23):456-457, 2003.
Saeidi et al., Engineering microbes to sense and eradicate Pseudomonas aeruginosa, a human pathogen. Mol Syst Biol, 7:521, 2011.
Sanger et al., Determination of a nucleotide sequence in Bacteriophage f1 DNA by primed synthesis with DNA polymerase. J.Mol. Biol., 90:315-333, 1974.
Sekirov et al., Gut microbiota in health and disease. Physiol Rev, 90:859-904, 2010.
Shareck et al., Cloning vectors based on cryptic plasmids isolated from lactic acid bacteria: their characteristics and potential applications in biotechnology. Crit Rev Biotechnol, 24(4):155-208, 2004.

(56) References Cited

OTHER PUBLICATIONS

Shu et al., Fermentation of Propionibacterium acnes, a commensal bacterium in the human skin microbiome, as skin probiotics against methicillin-resistant *Staphylococcus aureus*. PLoS One, 8:e55380, 2013.
Simon and Chopin. Construction of a vector plasmid family and its use for molecular cloning in *Streptococcus lactis*. Biochimic, 70:559-566, 1988.
Siuti et al., Synthetic circuits integrating logic and memory in living cells. Nat Biotech, 31:448-452, 2013.
Skaugen, M., The complete nucleotide sequence of a small cryptic plasmid from Lactobacillus plantarum. Plasmid, 22:175-179, 1989.
Smith et al., Use of axenic animals in studying the adaptation of mammals to their commensal intestinal microbiota. Semin Immunol, 19:59-69, 2007.
Smith et al., Whole-genome sequencing analysis reveals high specificity of CRISPR/Cas9 and TALEN-based genome editing in human iPSCs. Cell Stem Cell, 15:12-13, 2014.
St Jean et al., Bacterial delivery of *Staphylococcus aureus* alpha-hemolysin causes regression and necrosis in murine tumors. Mol Ther, 22:1266-1274, 2014.
Steidler et al., Biological containment of genetically modified Lactococcus lactis for intestinal delivery of human interleukin 10. Nature Biotechnology, 11(7):785-789, 2003.
Steidler et al., Treatment of murine colitis by Lactococcus lactis secreting interleukin-10. Science, 289:1352-1355, 2000.
Stivala et al., Specific structural determinants are responsible for the antioxidant activity and the cell cycle effects of resveratrol. The Journal of Biological Chemistry, 276(25): 22586-22594, 2001.
Sutherland and Griffin, Absorption spectrum of DNA for wavelenghts greater than 300 nm. Radial Res, 86(3):399-409, 1981.
Suzuki et al., Glucagon-like peptide 1 (1-37) converts intestinal epithelial cells into insulin-producing cells. Proc Natl Acad Sci U S A, 100:5034-5039, 2003.
Swofford et al., Quorum-sensing *Salmonella* selectively trigger protein expression within tumors. Proc Natl Acad Sci U S A, 112:3457-3462, 2015.
Takiguchi et al., Complete nucleotide sequence and characterization of a cryptic plasmid from *Lactobacillus helveticus* subsp. jugurti. Applied and Environmental Microbiology, 55(6):1653-1655, 1989.
Takiishi et al., Reversal of autoimmune diabetes by restoration of antigen-specific tolerance using genetically modified Lactococcus lactis in mice. J Clin Invest, 122:1717-1725, 2012.
Toley et al., Motility is critical for effective distribution and accumulation of bacteria in tumor tissue. Integr Biol (Camb), 4:165-176, 2012.
Tomida et al., Pan-Genome and comparative genome analyses of Propionibacterium acnes reveal its genomic diversity in the healthy and diseased human skin microbiome. mBio 4(3):e00003-13, 2013.
Toso et al., Phase I study of the intravenous administration of attenuated *Salmonella typhimurium* to patients with metastatic melanoma. J Clin Oncol, 20:142-152, 2002.
Turnbaugh et al., Diet-induced obesity is linked to marked but reversible alterations in the mouse distal gut microbiome. Cell Host Microbe, 3:213-223, 2008.
Unnikrishnan et al., Recombinant bacterial vaccines. Curr Opin Immunol, 24:337-342, 2012.
van de Guchte et al., Heterologous gene expression in Lactococcus lactis subsp. *lactis*: Synthesis, secretion, and processing of the Bacillus subtilis neutral protease. Applied and Environmental Microbiology, 56(9):2606-2611, 1990.
van der Vossen et al., Characterization of transcription initiation and termination signals of the Proteinase genes of Lactococcus lactis Wg2 and enhancement of proteolysis in L. lactis. Applied and Environmental Microbiology, 58(9):3142-3149, 1992.
van Kraneburg et al., Functional analysis of three plasmids from Lactobacillus plantarum. Applied and Environmental Microbiology, 71(3):1223-1230, 2005.
Vandenbroucke et al., Orally administered L. lactis secreting an anti-TNF nanobody demonstrate efficacy in chronic colitis. Mucosal Immunology, 3(1):49-56, 2010.
Vujcic et al., Molecular analysis of the rolling-circle replicating plasmid pA1 of Lactobacillus plantarum A112. Applied and Environmental Microbiology, 59(1):274-280, 1993.
Wallace et al., A set of synthetic oligodeoxyribonucleotide primers for DNA sequencing in the plasmid vector pBR322. Gene, 16:21-26, 1981.
Wang and Lee, Plasmids in Lactobacillus. Crit Rev Biotechnol. 17:227-72, 1997.
Wataha et al., Blue light differentially modulates cell survival and growth. Journal of Dental Research, 3 pages, 2004.
Weickert et al., Genetic analysis of the promoter region of the Bacillus subtilis alpha-Amylase gene. J. Bacteriol. 171:3656-66, 1989.
Wells et al., Lactococcus lactis: high-level expression of tetanus toxin fragment C and protection against lethal challenge. Molecular Microbiology, 8(6):1155-1162, 1993.
Westphal et al., Containment of tumor-colonizing bacteria by host neutrophils. Cancer Res 68:2952-2960, 2008.
Wheeland et al., Evaluation of self-treatment of mild-to-moderate facial acne with a blue light treatment system. J Drugs Dermatol, 10(6):596-602, 2011.
Woo et al., Then and now: use of 16S rDNA gene sequencing for bacterial identification and discovery of novel bacteria in clinical microbiology laboratories. Clinical Microbiology and Infection, 14(10):908-934, 2008.
Wright et al., GeneGuard: a modular plasmid system designed for biosafety. ACS Synth Biol, 4:307-316, 2015.
Xavier et al., Unravelling the pathogenesis of inflammatory bowel disease. Nature, 448:427-434, 2007.
Xiang et al., Short hairpin RNA-expressing bacteria elicit RNA interference in mammals. Nat Biotechnol, 24:697-702, 2006.
Xu et al., Dandruff is associated with the conjoined interactions between host and microorganisms. Scientific Reports, 6:24877, 9 pages, 2016.
Yagur-Kroll et al., Strategies for enhancing bioluminescent bacterial sensor performance by promoter region manipulation. Bioengineered Bugs, 1:151-153, 2010.
You et al., Model for the yeast cofactor A-beta-tubulin complex based on computational docking and mutagensis. JMB, 341:1343-1354, 2004.
Zhang and Forbes, Trg-deficient *Salmonella* colonize quiescent tumor regions by exclusively penetrating or proliferating. J Control Release, 199:180-189, 2015.
Aziz-Jalali et al., Comparison of red and infrared low-level laser therapy in the treatment of acne vulgaris. Indian Journal of Dermatology, 57(2):128-130, 2012.
PCT/US2017/028912 International Search Report and Written Opinion dated Jul. 26, 2017.
PCT/US2017/028918 International Search Report and Written Opinion dated Aug. 7, 2017.
Achermann et al., Propionibacterium acnes: from Commensal to Opportunistic Biofilm-Associated Implant Pathogen. Clinical Microbiology Reviews, 27(3):419-440, 2014.
Allaker et al., Cytotoxic activity of Propionibacterium acnes and other skin organisms. Br J Dermatol. 113(2):229-235, 1985.
Brüggemann et al., CriSPR/cas loci of type II propionibacterium acnes confer immunity against acquisition of mobile elements present in type I P. acnes. PLoS One. 7(3):1-10, 2012.
Corvec, et al., Is Hemolysis a Clinical Marker of Propionobacterium acnes Orthopedic Infection or a Phylogenetic Marker? Am J Orthop., E61-E62, 2015
Furukawa et al., Microbial pathogenesis characterization of Propionibacterium acnes isolates from sarcoid and non-sarcoid tissues with special reference to cell invasiveness, serotype, and trigger factor gene polymorphism. Microb Pathog. 46(2):80-87, 2009.
Graham et al., Pro-inflammatory cytokine production by human keratinocytes stimulated with Propionibacterium acnes and P. acnes GroEL. Br J Dermatol., 150:421-428, 2004.

(56) References Cited

OTHER PUBLICATIONS

Guidance on the assessment of the toxigenic potential of Bacillus species used in animal nutrition. European Food Safety Authority (EFSA), Parma, Italy. EFSA J 12(5)3665, 10 pages, 2014.

Hill, C. Virulence or niche factors: What's in a name? J Bacteriol. 194(21):5725-5727, 2012.

Kao and Huang. Acne vaccines targeting Propionibacterium acnes. G Ital Dermatol, 144(6):639-643, 2009. Abstract only.

Kilian et al., Multilocus Sequence Typing and Phylogenetic Analysis of Propionibacterium acnes. Journal of Clinical Microbiology, 50(4):1158-1165, 2012.

Kwon and Suh. Recent progress in the research about Propionibacterium acnes strain diversity and acne: pathogen or bystander? International Journal of Dermatology, 55:1196-1204, 2016.

Lodes, et al. Variable expression of immunoreactive surface proteins of Propionibacterium acnes. Microbiology. 152(12):3667-3681, 2006.

Mak et al. Comparative genomics reveals distinct host-interacting traits of three major human-associated propionibacteria. BMC Genomics, 14:640, 14 pages, 2013.

Miskin et al., Propionibacterium acnes, a resident of lipid-rich human skin, produces a 33 kDa extracellular lipase encoded by gehA. 143:1745-1755, 1997.

Nakase et al., Emergence of fluoroquinolone resistant Propionibacterium acnes caused by amino acid substitutions of DNA gyrase but not DNA topoisomerase IV. Anaerobe. 42:166-171, 2016.

Nord and Oprica. Antibiotic resistance in Propionibacterium acnes . Microbiological and clinical aspects. 12:207-210, 2006.

Oprica et al., Genetic basis of resistance in Propionibacterium acnes strains isolated from diverse types of infection in different European countries. Anaerobe, 11:137-143, 2005.

Patrick and McDowell. Family I. Propionibacteriaceae. In: Goodfellow et al., editors. Bergey's Manual of Systematic Bacteriology, Volume Five, The Actinobacteria, Part B. 2. New York: Springer, pp. 1138-1155, 2012.

Romano-Bertrand et al., Propionibacterium acnes populations involved in deep pathological samples and their dynamics along the cardiac surgical pathway. 34:287-301, 2015.

Scholz and Kilian. The natural history of cutaneous propionibacteria, and reclassification of selected species within the genus Propionibacterium to the proposed novel genera *Acidipropionibacterium* gen. nov., *Cutibacterium* gen. nov. and *Pseudopropionibacterium* gen. nov. Int J Syst Evol Microbiol. 66(11):4422-4432, 2016.

Scholz et al., Genome stability of Propionibacterium acnes: a comprehensive study of indels and homopolymeric tracts. Sci Rep. 6:20662, 13 pages, 2016.

Tax et al. Propionic Acid Produced by Propionibacterium acnes Strains contributes to Their Pathogenicity. Acta Derm Venereol. 96:43-49, 2016.

Tyner and Patel. Hyaluronidase in Clinical Isolates of Propionibacterium acnes. Int J Bacteriol. 2015:218918, 6 pages, 2015.

Valanne, et al. CAMP factor homologues in Propionibacterium acnes: a new protein family differentially expressed by types I and II. Microbiology, 151:1369-1379, 2005.

Wassenaar and Gaastra. Bacterial virulence: Can we draw a line? FEMS Microbiol Lett. 201:1-7, 2001.

Zankari et al. Identification of acquired antimicrobial resistance genes. J Antimicrob Chemother. 67(11):2640-2644, 2012.

\* cited by examiner

```
 1 AGTCGGTCCCAAGGGTTGGGCTGTTCGCCCATTAAAGCGGACGCGAGCTGGGTCAGAACGTCGTGAGACAGTTCGGTCCCTATCCG
 2 AGTCGGTCCCAAGGGTTGGGCTGTTCGCCCATTAAAGCGGACGCGAGCTGGGTCAGAACGTCGTGAGACAGTTCGGTCCCTATCCG
 3 AGTCGGTCCCAAGGGTTGGGCTGTTCGCCCATTAAAGCGGACGCGAGCTGGGTCAGAACGTCGTGAGACAGTTCGGTCCCTATCCG
 4 AGTCGGTCCCAAGGGTTGGGCTGTTCGCCCATTAAAGCGGACGCGAGCTGGGTCAGAACGTCGTGAGACAGTTCGGTCCCTATCCG
 5 AGTCGGTCCCAAGGGTTGGGCTGTTCGCCCATTAAAGCGGACGCGAGCTGGGTCAGAACGTCGTGAGACAGTTCGGTCCCTATCCG
 6 AGTCGGTCCCAAGGGTTGGGCTGTTCGCCCATTAAAGCGGACGCGAGCTGGGTTAGAACGTCGTGAGACAGTTCGGTCCCTATCCG
 7 AGTCGGTCCCAAGGGTTGGGCTGTTCGCCCATTAAAGCGGACGCGAGCTGGGTTAGAACGTCGTGAGACAGTTCGGTCCCTATCCG
 8 AGTCGGTCCCAAGGGTTGGGCTGTTCGCCCATTAAAGCGGACGCGAGCTGGGTTAGAACGTCGTGAGACAGTTCGGTCCCTATCCG
 9 AGTCGGTCCCAAGGGTTGGGCTGTTCGCCCATTAAAGCGGACGCGAGCTGGGTTAGAACGTCGTGAGACAGTTCGGTCCCTATCCG
10 AGTCGGTCCCAAGGGTTGGGCTGTTCGCCCATTAAAGCGGACGCGAGCTGGGTTAGAACGTCGTGAGACAGTTCGGTCCCTATCCG
11 AGTCGGTCCCAAGGGTTGGGCTGTTCGCCCATTAAAGCGGACGCGAGCTGGGTTAGAACGTCGTGAGACAGTTCGGTCCCTATCCG
```

FIG. 4

COMPOSITIONS AND METHODS FOR TREATMENT OF SKIN DISORDERS

CROSS-REFERENCE TO RELATED APPLICATIONS

This application claims priority to U.S. Provisional Ser. Nos. 62/325,851 filed on Apr. 21, 2016; 62/368,829 filed on Jul. 29, 2016; 62/368,837 filed on Jul. 29, 2016; 62/385,831 filed on Sep. 9, 2016; and 62/441,931 filed on Jan. 3, 2017 all of which are incorporated herein in their entirety.

SEQUENCE LISTING

The instant application contains a Sequence Listing which has been filed electronically in ASCII format and is hereby incorporated by reference in its entirety. Said ASCII copy, created on Apr. 20, 2017, is named 48236-706_201_SL.txt and is 2,294,816 bytes in size.

BACKGROUND OF THE INVENTION

The community of microorganisms living on and/or within an individual is the microbiome. The microbiome consists of many different bacterial species some of which are beneficial, neutral or deleterious to human health. Alterations in the microbiome have been connected to many disease states such as inflammatory diseases, metabolic disease, developmental diseases, psychological diseases and cancer. Determining the composition of the microbiome, and altering the microbiome from a pathological to healthy state holds great therapeutic promise for many different diseases.

SUMMARY

Provided herein are microbiome-based approaches to skin therapy using beneficial bacteria on the skin to eliminate or reduce harmful bacteria and restore skin to a healthy state. The methods and compositions disclosed herein may be used for a wide range of skin disorders including acne, eczema, psoriasis, rosacea and seborrheic dermatitis. Problems with current treatments for these disorders include antibiotic resistance, side effects, complicated regimens, and lack of long-term effectiveness. Treatments disclosed herein may provide alternatives to antibiotics, use healthy bacteria, present few side effects, with simple treatment regimens and long-term effectiveness.

Compositions described herein generally contain at least one health-associated microbe or probiotic that conveys beneficial effects to a subject with a skin disorder. Thus, the compositions disclosed herein are effective on the skin (e.g., at skin temperature). These compositions sometimes contain a mixture of several strains that have each been isolated, purified, selected or engineered to provide a specific cocktail of bacteria that does not occur in nature. These strains can be stored or packaged with a preservative agent, such as glycerol or polyethylene glycol in a container or on an applicator such as a cotton swab, as shown in FIG. 1. These containers and applicators can be stored in a freezer, refrigerator or on a shelf at room temperature, both before and during use.

Many of the compositions and methods disclosed herein comprise bacteria known as *Propionibacterium acnes*, abbreviated *P. acnes*, and uses thereof, respectively. However, other bacteria, including genetically modified strains, and uses thereof are also contemplated herein. Some strains of *P. acnes* used in compositions and methods disclosed herein are referred to herein as healthy strains of *P. acnes* or, for simplicity, "healthy *P. acnes*." Healthy strains of *P. acnes* generally promote skin health by preventing a skin disorder or reducing symptoms of a skin disorder. Healthy strains of *P. acnes* may even promote skin health by eliminating the cause of a skin disorder. Other strains of *P. acnes* are referred to herein as pathogenic strains or "pathogenic *P. acnes*." Pathogenic *P. acnes* generally promote or cause a skin disorder or symptoms thereof. Generally, pathogenic *P. acnes* are not used in compositions and methods described herein. Instead, methods and compositions disclosed herein may be useful in reducing or preventing growth of pathogenic *P. acnes* on the skin of a subject. In some cases, an amount of *P. acnes* can be considered healthy or pathogenic, too much or too little being desirable or undesirable. In some cases, a combination of multiple *P. acnes* strains confers health. Conversely, in some cases, a different combination of multiple *P. acnes* strains can be pathogenic. Strains of *P. acnes*, combinations thereof, and amounts thereof that are healthy and pathogenic are described herein.

Compositions and methods disclosed herein may comprise bacteria with a given genetic signature and uses thereof, respectively. While *P. acnes* is the bacteria primarily exemplified herein, it is contemplated that other bacteria having a particular genetic signature that is similar to healthy *P. acnes* could likewise be useful for compositions and methods disclosed herein. For example, many *P. acnes* strains that are identified as healthy herein comprise a combination of a deoxyribose operon repressor (deoR), a type II lipase, and a CRISPR associated Cas endonuclease. Additionally, healthy *P. acnes* strains are generally associated with an absence or only small amounts of an extrachromosomal plasmid known in the art as pIMPLE plasmids. It has previously been reported that some strains of *P. acnes* harbor an extrachromosomal plasmid, given the term, "pIMPLE plasmid," by those in the field. Such plasmids are readily found in the art. pIMPLE plasmids may have multiple open reading frames (ORFs). The presence of these aforementioned genes (e.g., deoR, lipase, Cas) and/or a low presence of pIMPLE plasmid may provide a healthy skin promoting genetic signature that can be used to identify bacteria other than *P. acnes* that are useful in compositions and methods of treating *acnes* described herein.

In some aspects, disclosed herein are pharmaceutical compositions that comprise: a first therapeutically effective amount of a first health-associated *Propionibacterium* microbe, wherein the first health-associated *Propionibacterium* microbe produces less than about one micromolar porphyrin; a second therapeutically effective amount of a second health-associated microbe; and a pharmaceutically acceptable excipient or biological stabilizer. In some embodiments, the second health-associated microbe comprises a strain of *Propionibacterium*. In some embodiments, the second health-associated microbe produces less than about one micromolar porphyrin. In some embodiments, the first health-associated *Propionibacterium* microbe and the second health-associated *Propionibacterium* microbe collectively produce less than about one micromolar porphyrin. In some embodiments, at least one of the first health-associated *Propionibacterium* microbe and the second health-associated *Propionibacterium* microbe produce less than about 200 nM porphyrin. In some embodiments, at least one of the first health-associated *Propionibacterium* microbe and the second health-associated *Propionibacterium* microbe produce less than about 100 nM porphyrin. In some embodiments, the first health-associated *Propionibacterium* microbe and the second health-associated *Propionibacte-*

*rium* microbe collectively produce less than about 100 nM porphyrin. In some embodiments, at least one of the first health-associated *Propionibacterium* microbe and the second health-associated *Propionibacterium* microbe produce less than about one micromolar porphyrin in situ. In some embodiments, at least one of the first health-associated *Propionibacterium* microbe and the second health-associated *Propionibacterium* microbe produce less than about one micromolar porphyrin in vitro. In some embodiments, at least the first health-associated *Propionibacterium* microbe comprises a strain of *Propionibacterium acnes, Propionibacterium granulosum, Propionibacterium avidum*, or *Propionibacterium acnes* subsp. *defendens*. In some embodiments, at least the first health-associated *Propionibacterium* microbe comprises a strain of *Propionibacterium acnes*. In some embodiments, at least the first health-associated *Propionibacterium* microbe comprises a *Propionibacterium acnes* of a ribotype RT1 or RT2. In some embodiments, at least the first health-associated *Propionibacterium* microbe: (a) comprises at least one gene encoding an ATP binding cassette transporter; (b) comprises at least one gene encoding at least one of a deoxyribose operon repressor and a type II lipase, and less than about 10% pIMPLE plasmid; or (c) lacks at least one gene encoding a DNA binding response regulator or a phosphoglycerate kinase.

In some aspects, disclosed herein are pharmaceutical compositions that comprise: (a) a therapeutically effective amount of a health-associated *Propionibacterium acnes* microbe, wherein the health-associated *Propionibacterium acnes* microbe is characterized by at least one of the following: comprises at least one gene encoding at least one of a deoxyribose operon repressor and a type II lipase, and less than about 10% pIMPLE plasmid; comprises at least one gene encoding an ATP binding cassette transporter; or lacks at least one gene encoding a DNA binding response regulator or a phosphoglycerate kinase, and (b) a pharmaceutically acceptable excipient or biological stabilizer. In some embodiments, the health-associated *Propionibacterium acnes* microbe has been engineered or selected to comprise a deoxyribose operon repressor and a type II lipase. In some embodiments, a Cas5 protein is absent from the health-associated *Propionibacterium acnes* microbe. In some embodiments, the health-associated *Propionibacterium acnes* microbe expresses an ATP binding cassette transporter. In some embodiments, the health-associated *Propionibacterium acnes* microbe does not express a DNA binding response regulator or a phosphoglycerate kinase. In some embodiments, the health-associated *Propionibacterium acnes* microbe comprises an RT1 or RT2 ribotype. In some embodiments, the health-associated *Propionibacterium acnes* microbe does not comprise an RT6 ribotype. In some embodiments, the health-associated *Propionibacterium acnes* microbe comprises a mixture of two or more different ribotypes of *Propionibacterium acnes*. In some embodiments, the health-associated *Propionibacterium acnes* microbe comprises an HP3A11 strain, an HP3B4 strain, an HP4G1 strain, or an HP5G4 strain. In some embodiments, the pharmaceutical probiotic composition comprises an additional strain of bacteria, wherein the additional strain comprises *Propionibacterium avidum* or *Propionibacterium granulosum*. In some embodiments, the additional strain comprises *Propionibacterium acnes* subsp. *defendens*.

In some aspects, disclosed herein are methods of treating a skin disorder or condition comprising applying a therapeutically effective amount of a pharmaceutical probiotic composition comprising: (a) a therapeutically effective amount of a health-associated *Propionibacterium acnes* microbe, wherein the health-associated *Propionibacterium acnes* microbe is characterized by at least one of the following: comprises at least one gene encoding at least one of a deoxyribose operon repressor and a type II lipase, and less than about 10% pIMPLE plasmid; comprises at least one gene encoding an ATP binding cassette transporter; or lacks at least one gene encoding a DNA binding response regulator or a phosphoglycerate kinase, and (b) a pharmaceutically acceptable excipient or biological stabilizer. In some embodiments, the skin disorder or condition comprises acne, eczema, seborrheic dermatitis, psoriasis, or rosacea, or a combination thereof. In some embodiments, the health-associated *Propionibacterium acnes* microbe has been engineered or selected to at least one gene encoding the deoxyribose operon repressor and the type II lipase. In some embodiments, a Cas5 protein is absent from the health-associated *Propionibacterium acnes* microbe. In some embodiments, the health-associated *Propionibacterium acnes* microbe comprises an RT1 or RT2 ribotype. In some embodiments, the health-associated *Propionibacterium acnes* microbe does not comprise an RT6 ribotype. In some embodiments, the health-associated *Propionibacterium acnes* microbe comprises a mixture of two or more different ribotypes. In some embodiments, the health-associated *Propionibacterium acnes* microbe comprises an HP3A11 strain, an HP3B4 strain, an HP4G1 strain, or an HP5G4 strain. In some embodiments, the pharmaceutical probiotic composition comprises an additional strain of bacteria, wherein the additional strain comprises *Propionibacterium avidum* or *Propionibacterium granulosum*. In some embodiments, the additional strain comprises *Propionibacterium acnes* subsp. *defendens*.

In some aspects, disclosed herein are pharmaceutical probiotic compositions that comprise: (a) a first therapeutically effective amount of a health-associated *Propionibacterium acnes* microbe, wherein the first health-associated *Propionibacterium acnes* microbe is characterized by at least one of the following: comprises at least one gene encoding at least one of a deoxyribose operon repressor and a type II lipase, and less than about 10% pIMPLE plasmid; comprises at least one gene encoding an ATP binding cassette transporter; or lacks at least one gene encoding a DNA binding response regulator or a phosphoglycerate kinase; (b) a second therapeutically effective amount of a second health-associated microbe, wherein the second health-associated microbe has been engineered or selected to comprise at least one gene encoding at least one of a deoxyribose operon repressor and a type II lipase, and less than about 10% pIMPLE plasmid; and (c) a pharmaceutically acceptable excipient or biological stabilizer. In some embodiments, the second health-associated microbe is a strain of bacteria comprising *P. acnes, P. granulosum*, or *P. avidum*. In some embodiments, the second health-associated microbe is a strain of bacteria comprising *Propionibacterium acnes* subsp. *defendens*.

In some aspects, disclosed herein are pharmaceutical compositions that comprise: (a) a pharmaceutically acceptable excipient or biological stabilizer; and (b) a therapeutically effective amount of a health-associated *Propionibacterium acnes* microbe, wherein the health-associated *Propionibacterium acnes* microbe does not express a DNA binding response regulator, a phosphoglycerate kinase, or a combination thereof. In some aspects, disclosed herein are pharmaceutical compositions that comprise: (a) a pharmaceutically acceptable excipient or biological stabilizer; and (b) a therapeutically effective amount of a health-associated

*Propionibacterium acnes* microbe, wherein the health-associated *Propionibacterium acnes* microbe expresses an ATP-binding cassette transporter. In some aspects, disclosed herein are pharmaceutical compositions that comprise: (a) a pharmaceutically acceptable excipient or biological stabilizer; and (b) a therapeutically effective amount of a health-associated *Propionibacterium acnes* microbe, wherein the health-associated *Propionibacterium acnes* microbe: does not express a DNA binding response regulator, a phosphoglycerate kinase, or a combination thereof; and expresses an ATP-binding cassette transporter. In some embodiments, the DNA binding response regulator is encoded by a sequence of SEQ ID NO: 7. In some embodiments, the DNA binding response regulator is encoded by a sequence that is at least 50% homologous to a sequence of SEQ ID NO: 7. In some embodiments, the phosphoglycerate kinase is encoded by a sequence of SEQ ID NO: 9. In some embodiments, the phosphoglycerate kinase is encoded by a sequence that is at least 50% homologous to a sequence of SEQ ID NO: 9. In some embodiments, the ATP-binding cassette transporter is encoded by a sequence of SEQ ID NO: 6. In some embodiments, the ATP-binding cassette transporter is encoded by a sequence that is at least 50% homologous to a sequence of SEQ ID NO: 6. In some embodiments, the pharmaceutical composition comprises at least two strains of bacteria. In some embodiments, the pharmaceutical composition comprises a strain of *Propionibacterium acnes* having a ribotype of RT1, RT2, RT3, RT4 or RT5. In some embodiments, the pharmaceutical composition comprises a strain of *Propionibacterium acnes* having a ribotype of RT1 or RT2. In some embodiments, the health-associated *Propionibacterium acnes* microbe does not comprise an RT6 ribotype. In some embodiments, the pharmaceutical composition is formulated for topical administration. In some embodiments, the pharmaceutical composition is in the form of a gel, ointment, lotion, emulsion, paste, cream, foam, mousse, liquid, spray, suspension, dispersion and aerosol. In some embodiments, the pharmaceutical composition comprises a liposome or nanoparticle. In some embodiments, the health-associated *Propionibacterium acnes* microbe comprises a deoxyribose operon repressor and a type II lipase. In some embodiments, a Cas5 protein is absent from the health-associated *Propionibacterium acnes* microbe. In some embodiments, the health-associated *Propionibacterium acnes* microbe comprises less than about 1% pIMPLE plasmid. In some embodiments, the health-associated *Propionibacterium acnes* microbe comprises less than about 0.3% pIMPLE plasmid. In some embodiments, the health-associated *Propionibacterium acnes* microbe comprises a mixture of two or more different ribotypes of *Propionibacterium acnes*. In some embodiments, the pharmaceutically acceptable excipient or biological stabilizer increases the viability of the health-associated *Propionibacterium acnes* microbe at a temperature from about −10° C. to about 30° C. In some embodiments, the pharmaceutical composition comprises an additional strain of bacteria. In some embodiments, the pharmaceutical composition comprises an additional strain of bacteria, wherein the additional strain comprises *Propionibacterium avidum* and *Propionibacterium granulosum*. In some embodiments, the additional strain comprises *Propionibacterium acnes* subsp. *defendens*. In some embodiments, the health-associated *Propionibacterium acnes* microbe is selected, transformed or engineered to: (a) comprise at least one gene encoding at least one of a deoxyribose operon repressor and a type II lipase, and less than about 10% pIMPLE plasmid; (b) comprise at least one gene encoding an ATP binding cassette transporter; or (c) lack at least one gene encoding a DNA binding response regulator or a phosphoglycerate kinase.

In some aspects, methods of treating a skin disorder or condition are provided comprising applying a therapeutically effective amount of a pharmaceutical composition disclosed herein. In some embodiments, the skin disorder or condition comprises acne, eczema, seborrheic dermatitis, psoriasis, or rosacea, or a combination thereof.

In some aspects, disclosed herein are pharmaceutical probiotic compositions comprising: (a) a therapeutically effective amount of a health-associated *Propionibacterium acnes* microbe, wherein the health-associated *Propionibacterium acnes* microbe has been engineered or selected to comprise at least one gene encoding at least one of a deoxyribose operon repressor and a type II lipase, and less than about 10% pIMPLE plasmid; and (b) a pharmaceutically acceptable excipient or biological stabilizer. In some embodiments, the health-associated *Propionibacterium acnes* microbe has been engineered or selected to comprise a deoxyribose operon repressor and a type II lipase. In some embodiments, a Cas 5 protein is absent from the health-associated *Propionibacterium acnes* microbe. In some embodiments, the health-associated *Propionibacterium acnes* microbe comprises an RT1 or RT2 ribotype. In some embodiments, the health-associated *Propionibacterium acnes* microbe does not comprise an RT6 ribotype. In some embodiments, the health-associated *Propionibacterium acnes* microbe comprises less than about 1% pIMPLE plasmid. In some embodiments, the health-associated *Propionibacterium acnes* microbe comprises less than about 0.3% pIMPLE plasmid. In some embodiments, the health-associated *Propionibacterium acnes* microbe comprises a mixture of two or more different ribotypes of *Propionibacterium acnes*. In some embodiments, the pharmaceutically acceptable excipient or biological stabilizer increases the viability of the health-associated *Propionibacterium acnes* microbe at a temperature from about −10° C. to about 30° C. In some embodiments, the health-associated *Propionibacterium acnes* microbe comprises an HP3A11 strain, an HP3B4 strain, an HP4G1, or an HP5G4 strain. In some embodiments, the pharmaceutical probiotic composition comprises an additional strain of bacteria, wherein the additional strain comprises *Propionibacterium avidum* or *Propionibacterium granulosum*. In some embodiments, the additional strain comprises *Propionibacterium acnes* subsp. *defendens*. In some embodiments, the health-associated *Propionibacterium acnes* microbe expresses an ATP binding cassette transporter. In some embodiments, the health-associated *Propionibacterium acnes* microbe does not express a DNA binding response regulator or a phosphoglycerate kinase.

In some aspects, disclosed herein are methods of treating a skin disorder or condition comprising applying a therapeutically effective amount of a pharmaceutical probiotic composition comprising: (a) a therapeutically effective amount of a health-associated *Propionibacterium acnes* microbe, wherein the health-associated *Propionibacterium acnes* microbe has been engineered or selected to comprise at least one gene encoding at least one of a deoxyribose operon repressor and a type II lipase, and less than about 10% pIMPLE plasmid; and (b) a pharmaceutically acceptable excipient or biological stabilizer. In some embodiments, the skin disorder or condition comprises acne, eczema, seborrheic dermatitis, psoriasis, or rosacea. In some embodiments, the health-associated *Propionibacterium acnes* microbe has been engineered or selected to at least one gene encoding the deoxyribose operon repressor and the type II lipase. In some embodiments, the Cas5 protein is absent from the health-associated *Propionibacterium acnes* microbe. In some embodiments, the health-associated *Propionibacterium acnes* microbe comprises an RT1 or RT2 ribotype. In some embodiments, the health-associated *Propionibacterium acnes* microbe does not comprise an RT6 ribotype. In some embodiments, the health-associated *Propionibacterium acnes* microbe comprises less than about 1% pIMPLE plasmid. In some embodiments, the health-associated *Propionibacterium acnes* microbe comprises less than about 0.3% pIMPLE plasmid. In some embodiments, the health-associated *Propionibacterium acnes* microbe comprises a mixture of two or more different ribotypes. In some embodiments, the pharmaceutically acceptable excipient or biological stabilizer increases the viability of the health-associated *Propionibacterium acnes* microbe at a temperature from about −10° C. to about 30° C. In some embodiments, the health-associated *Propionibacterium acnes* microbe comprises at least one of an HP3A11 strain, an HP3B4 strain, or HP4G1 strain, or an HP5G4 strain. In some embodiments, the pharmaceutical probiotic composition comprises an additional strain of bacteria, wherein the additional strain comprises *Propionibacterium avidum* or *Propionibacterium granulosum*. In some embodiments, the additional strain comprises *Propionibacterium acnes* subsp. *defendens*.

In some aspects, disclosed herein are pharmaceutical probiotic compositions comprising: (a) a first therapeutically effective amount of a first health-associated *Propionibacterium acnes* microbe, wherein the first health-associated *Propionibacterium acnes* microbe has been engineered or selected to at least one gene encoding at least one of a deoxyribose operon repressor and a type II lipase, and less than about 10% pIMPLE plasmid; (b) a second therapeutically effective amount of a second health-associated *Propionibacterium acnes* microbe, wherein the second health-associated *Propionibacterium acnes* microbe has been engineered or selected to comprise at least one gene encoding at least one of a deoxyribose operon repressor and a type II lipase, and less than about 10% pIMPLE plasmid; and (c) a pharmaceutically acceptable excipient or biological stabilizer. In some embodiments, the first or the second health-associated *Propionibacterium acnes* microbe has been engineered or selected to comprise: (i) at least one gene encoding the deoxyribose operon repressor and the type II lipase, (ii) at least one gene encoding the deoxyribose operon repressor and less than about 10% pIMPLE plasmid, or (iii) at least one gene encoding the type II lipase and less than about 10% pIMPLE plasmid. In some embodiments, the first and the second health-associated *Propionibacterium acnes* microbe has been engineered or selected to comprise: (i) at least one gene encoding the deoxyribose operon repressor and the type II lipase, (ii) at least one gene encoding the deoxyribose operon repressor and less than about 10% pIMPLE plasmid, or (iii) at least one gene encoding the type II lipase and less than about 10% pIMPLE plasmid. In some embodiments, the first or the second health-associated *Propionibacterium acnes* microbe has been engineered or selected to comprise at least one gene encoding the deoxyribose operon repressor, the type II lipase, and less than about 10% pIMPLE plasmid. In some embodiments, the first and the second health-associated *Propionibacterium acnes* microbe has been engineered or selected to comprise at least one gene encoding the deoxyribose operon repressor, the type II lipase, and less than about 10% pIMPLE plasmid. In some embodiments, the first and the second health-associated *Propionibacterium acnes* microbes are different strains. In some embodiments, the first or the second health-associated *Propionibacterium acnes* microbe comprises an RT1 or RT2 ribotype. In some embodiments, the first health-associated *Propionibacterium acnes* microbe comprises an RT1 ribotype and the second health-associated *Propionibacterium acnes* microbe comprises an RT2 ribotype. In some embodiments, neither the first nor the second health-associated *Propionibacterium acnes* microbe comprises an RT6 ribotype. In some embodiments, the pharmaceutically acceptable excipient or biological stabilizer increases the viability of the health-associated *Propionibacterium acnes* microbe at a temperature from about −10° C. to about −30° C. In some embodiments, the health-associated *Propionibacterium acnes* microbe comprises at least one of an HP3A11 strain, an HP3B4 strain, or HP4G1 strain, or an HP5G4 strain. In some embodiments, the first or second health-associated *Propionibacterium acnes* microbe expresses an ATP binding cassette transporter. In some embodiments, the first or second health-associated *Propionibacterium acnes* microbe does not express a DNA binding response regulator or a phosphoglycerate kinase. In some aspects, the pharmaceutical probiotic compositions disclosed herein are for use in the treatment of a skin disorder or condition.

In some aspects, disclosed herein are methods of producing a desired preparation of a *Propionibacterium acnes* bacteria, said method comprising: (a) adding a sample of the *Propionibacterium acnes* bacteria to a glycerol solution to produce a *Propionibacterium acnes* glycerol stock, and (b) storing the *Propionibacterium acnes* glycerol stock at a temperature of about 4° C. or less, wherein more than about 50% of the *P. acnes* bacteria is viable when the *Propionibacterium acnes* bacteria in the glycerol solution is brought to ambient temperature. In some embodiments, the glycerol solution is between about 25% and about 75% glycerol. In some embodiments, the glycerol solution is about 50% glycerol. In some embodiments, the temperature is between about 4° C. and about −80° C. In some embodiments, the temperature is about −20° C. In some embodiments, at least about 70% to at least about 90% of the sample is viable after the *Propionibacterium acnes* glycerol stock is brought to ambient temperature. In some embodiments, at least about 90% of the sample is viable after the *Propionibacterium acnes* glycerol stock is brought to ambient temperature. In some embodiments, the ambient temperature is between about 20° C. and about 30° C. In some embodiments, the ambient temperature is about 25° C. In some embodiments, the *Propionibacterium acnes* glycerol stock is brought to ambient temperature before about 90 days of initiating storing. In some embodiments, more than 50% of the sample is viable after about 20 days of storing. In some embodiments, more than about 50% of the sample is viable after about 90 days of storing. In some embodiments, more than about 50% of the sample is viable at least up to about 90 days of storing. In some embodiments, the *Propionibacterium acnes* bacteria comprises an HP3A11 strain, an HP3B4 strain, or HP4G1 strain, or an HP5G4 strain.

In some aspects, disclosed herein are methods of producing a desired preparation of a preserved *Propionibacterium acnes* sample, wherein at least about 90% of said preserved *Propionibacterium acnes* sample is viable after sixty days of storage, said method comprising: (a) adding a sample of *Propionibacterium acnes* bacteria to a solution of between about 25% and about 50% glycerol in phosphate buffered saline solution to produce a *Propionibacterium acnes* glycerol stock; and (b) cooling the *Propionibacterium acnes* glycerol stock at a temperature from about −20° C. to about 4° C., thereby forming said desired preparation wherein at least about 90% of said sample of *Propionibacterium acnes* bacteria is viable after sixty days of storage. In some aspects, disclosed herein are methods of producing a desired preparation of a preserved *Propionibacterium acnes* sample, wherein at least about 90% of said preserved *Propionibacterium acnes* sample is viable after ninety days of storage, said method comprising: adding a sample of *Propionibacterium acnes* bacteria to a solution of about 50% glycerol to produce a *Propionibacterium acnes* glycerol stock; and freezing the *Propionibacterium acnes* glycerol stock at −20° C., thereby forming said desired preparation wherein at least about 90% of said sample of *Propionibacterium acnes* bacteria is viable after a thawing of the *Propionibacterium acnes* glycerol stock. In some embodiments, the methods comprise thawing the *Propionibacterium acnes* glycerol stock at room temperature. In some embodiments, the solution is about 25-50% glycerol v/v in water. In some embodiments, the solution is about 25-50% glycerol v/v in a buffered solution. In some embodiments, the buffered solution is a phosphate buffered saline. In some embodiments, the buffered solution is an acetate buffered solution. In some embodiments, the solution comprises potassium. In some embodiments, the solution comprises potassium at a concentration of about 150 mM to about 200 mM. In some embodiments, the solution comprises calcium. In some embodiments, the solution comprises calcium at a concentration of about 0.05 mM to about 0.1 mM. In some embodiments, the solution comprises a prebiotic stabilizing agent. In some embodiments, the prebiotic stabilizing agent is inulin. In some embodiments, the inulin is present in the solution at a concentration of about 0.05% v/v to about 0.2% v/v. In some embodiments, the solution comprises an anti-acne agent. In some embodiments, the anti-acne agent comprises a retinoid, a vitamin, an antioxidant, a peroxide, an acid, an oil, an alcohol, an extract, or an analog thereof. In some embodiments, the retinoid comprises tretinoin, tazarotene, adapalene, or retinol. In some embodiments, the vitamin or analog thereof comprises Vitamin D, Vitamin C, Vitamin E, or calciptotriene. In some embodiments, the antioxidant comprises Vitamin C or Vitamin E. In some embodiments, the peroxide is benzoyl peroxide. In some embodiments, the acid comprises salicylic acid, azaelic acid, trichloracetic acid, or glycolic acid. In some embodiments, the alcohol comprises retinol or resveratrol. In some embodiments, the oil is tea tree oil. In some embodiments, the extract is a green tea extract. In some embodiments, the solution is incorporated in a biologic stability platform to eliminate cold chain storage. In some embodiments, the biologic storage platform comprises foam drying or foam formation of the solution or glycerol stock solution. In some embodiments, the solution comprises at least one of a glyconanoparticle, a liposome, a nanoparticle, trehalose, sucrose, stachyose, hydroxyethyl starch, or a combination of glycine and mannitol. In some embodiments, the sample of *Propionibacterium acnes* bacteria comprises *Propionibacterium acnes* bacteria of ribotype RT1. In some embodiments, the sample of *Propionibacterium acnes* bacteria comprises *Propionibacterium acnes* bacteria of ribotype RT2. In some embodiments, the sample of *Propionibacterium acnes* bacteria comprises *Propionibacterium acnes* bacteria of ribotype RT1 and RT2. In some embodiments, the *Propionibacterium acnes* bacteria is characterized by at least one of the following: comprises a deoR protein; comprises a type II lipase; comprises less than 10% pIMPLE plasmid; does not comprise a Cas5 protein; comprises an ATP binding cassette transporter protein; does not comprise a DNA binding response regulator; and does not comprise a phosphoglycerate kinase. In some embodiments, the sample of *Propionibacterium acnes* bacteria comprises *Propionibacterium acnes* an HP3A11 strain, an HP3B4 strain, or HP4G1 strain, or an HP5G4 strain.

BRIEF DESCRIPTION OF THE DRAWINGS

FIG. 4 shows a portion of a 23S, ribosomal RNA sequence from bacteria commonly found on the human face that enables characterization of a subject's skin microbiome. Numbers listed to the left of sequences correspond to bacterial strains as follows: (1) *P. acnes*_KPA171202_RT1_2; (2) *P. acnes*_KPA171202_RT1_3; (3) *P. acnes* ATCC 11828_RT2_1; (4) *P. acnes* ATCC 11828_RT2_2; (5) *P. avidum* 44067; (6) *P. acidipropionici* ATCC 4875; (7) *S. aureus* 04-02981; (8) *S. aureus* Bmb9393; (9) *S. aureus* FDA209P; (10) *S. epidermidis* ATCC 12228; and (11) *S. epidermidis* PM221. Sequences 1-5 correspond to SEQ ID NOs: 33 to 37. Sequence 6 corresponds to SEQ ID NO: 38. Sequences 7-11 correspond to SEQ ID NOs: 39-43.

DETAILED DESCRIPTION OF THE INVENTION

Figure 1:
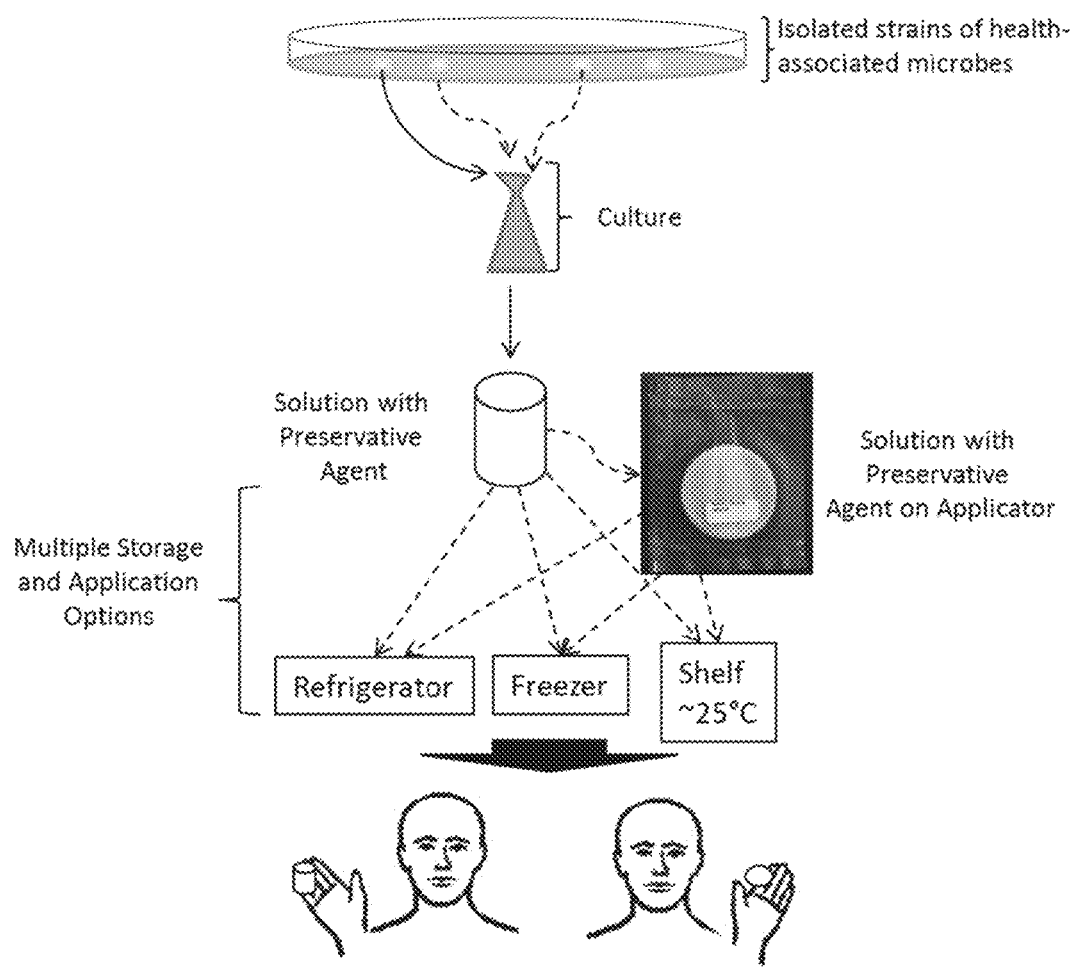
FIG. 1 illustrates exemplary production and packaging of compositions of health-associated microbes disclosed herein. Dashed lines indicate optional steps.

In the following description, certain specific details are set forth in order to provide a thorough understanding of various embodiments. However, one skilled in the art will understand that the embodiments provided may be practiced without these details. Unless the context requires otherwise, throughout the specification and claims which follow, the word "comprise" and variations thereof, such as, "comprises" and "comprising" are to be construed in an open, inclusive sense, that is, as "including, but not limited to." As used in this specification and the appended claims, the singular forms "a," "an," and "the" include plural referents unless the content clearly dictates otherwise. It should also be noted that the term "or" is generally employed in its sense including "and/or" unless the content clearly dictates otherwise. Further, headings provided herein are for convenience only and do not interpret the scope or meaning of the claimed embodiments.

As used herein the term "about" refers to an amount that is near the stated amount by about 10%, 5%, or 1%.

As used herein "consisting essentially of" when used to define compositions and methods, shall mean excluding other elements of any essential significance to the combination for the stated purpose. Thus, a composition consisting essentially of the elements as defined herein would not exclude other materials or steps that do not materially affect the basic and novel characteristic(s) of the claimed disclosure, such as compositions for treating skin disorders like acne, eczema, psoriasis, and rosacea.

As used herein "health-associated" means a microbe that is more prevalent in healthy or disease free individuals than in individuals diagnosed with a given disorder. In certain embodiments, the disease may be acne, eczema, seborrheic dermatitis, psoriasis, rosacea, or any combination thereof. A health-associated microbe can be determined statistically. For example, by comparing the microbiome or the prevalence of certain microbial species or strains on the skin, in the oral cavity, or in the digestive system of a healthy non-disease afflicted individual as compared to an individual with a given disease. Genera, species, or strains that are more prevalent in/on healthy individuals are health-associated. A health-associated strain can also be a strain that has been genetically modified or selected to express low levels of virulence factors that are associated with a given skin disease. A health-associated strain can also be a strain that has been genetically modified or selected to express high levels of beneficial genes, RNAs, or proteins that are associated with protection from a given skin disease. A health-associated strain can also be a strain that has been genetically modified or selected to express, not express, or express desirable levels of markers, as described herein.

As used herein a "probiotic' is a microbe that provides health benefits when consumed or applied. In some instances, probiotics disclosed herein are microbes that inhibit the activity or growth of a disease causing bacteria associated with acne, eczema, seborrheic dermatitis, psoriasis, or rosacea.

As used herein, the terms "homologous," "homology," or "percent homology" when used herein to describe to an amino acid sequence or a nucleic acid sequence, relative to a reference sequence, can be determined using the formula described by Karlin and Altschul (Proc. Natl. Acad. Sci. USA 87: 2264-2268, 1990, modified as in Proc. Natl. Acad. Sci. USA 90:5873-5877, 1993). Such a formula is incorporated into the basic local alignment search tool (BLAST) programs of Altschul et al. (J. Mol. Biol. 215: 403-410, 1990). Percent homology of sequences can be determined using the most recent version of BLAST, as of the filing date of this application.

Strains of *Propionibacterium acnes*, HP3A11, HP4G1 and HP5G4, described herein, were deposited in the American Tissue Culture Collection (10801 University Boulevard Manassas, Va. 20110-2209 USA) on Apr. 6, 2017 in accordance with and under the provisions of the Budapest Treaty for the International Recognition of the Deposit of Microorganisms for the Purpose of Patent Procedure. The strains were tested by the ATCC and determined to be viable. The ATCC has assigned ATCC deposit accession numbers: PTA-124010 to strain HP3A11; PTA-124011 to strain HP4G1; and PTA 124012 to HP5G4.

Provided throughout this application are compositions and methods for the treatment of skin disorders. It is should be understood that compositions disclosed herein may be used according to methods described herein. Conversely, methods disclosed herein may appropriately employ compositions disclosed herein.

Compositions for Treatments of Skin Disorders

In some aspects, the disclosure provides compositions comprising a strain of bacteria. The strain of bacteria is generally a strain that promotes, restores or improves skin health. In some embodiments, compositions disclosed herein comprise at least one health-associated strain of bacteria. In some embodiments, the at least one health-associated strain of bacteria is a strain of *Propionibacterium* bacteria. In some embodiments, the at least one health-associated strain of bacteria is a strain of *Staphylococcus* bacteria. In some embodiments, the at least one health-associated strain of bacteria is a strain of *Lactobacillus* bacteria. In some embodiments, the composition is formulated for application to the skin of a subject.

In some embodiments, compositions disclosed herein comprise a fungus. The fungus is generally a fungus that promotes, restores or improves skin health. In some embodiments, compositions disclosed herein comprise at least one health-associated fungus. In some embodiments, the fungus is *Malassezia*.

In some embodiments, compositions disclosed herein comprise a bacteriophage, also referred to herein as a phage for simplicity. In some embodiments, the bacteriophage is a *Propionibacterium* phage. In some embodiments, the bacteriophage is a health-associated *Propionibacterium* phage. In some embodiments, the health-associated *Propionibacterium* phage is a phage found on skin of a subject that is free of a skin disorder. In some embodiments, the health-associated *Propionibacterium* phage is a phage found on skin of a subject that is free of acne. In some embodiments, the health-associated *Propionibacterium* phage is a phage found on skin of a subject that is free of eczema. In some embodiments, the health-associated *Propionibacterium* phage is a phage found on skin of a subject that is free of psoriasis. In some embodiments, the health-associated *Propionibacterium* phage is a phage found on skin of a subject that is free of seborrheic dermatitis. In some embodiments, the health-associated *Propionibacterium* phage is a phage found on skin of a subject that is free of rosacea. In some embodiments, the health-associated *Propionibacterium* phage is a phage that is more abundant or prevalent on skin free of a skin disorder than skin with a skin disorder. In some embodiments, the bacteriophage is a *Propionibacterium acnes* phage. In some embodiments, the *Propionibacterium acnes* phage targets a select strain of *P. acnes*. In some embodiments, the *Propionibacterium acnes* phage targets a pathogenic strain of *P. acnes*. Non-limiting examples of *Propionibacterium acnes* phages are described in Farrar et al. (2007) J. Bacteriol., vol. 189, pp. 4161-4167, and Liu et al. (2015) ISME J, vol. 9, pp. 2078-2093.

In some embodiments, the at least one health-associated strain of bacteria is a strain of *Propionibacterium acnes* (referred to herein as *P. acnes*). In some embodiments, the at least one health-associated strain of bacteria is not a strain of P. acnes subsp. acnes. In some embodiments, the at least one health-associated strain of bacteria is a strain of *Propionibacterium avidum* (referred to herein as P. avidum). In some embodiments, the at least one health-associated strain of bacteria is a strain of *Propionibacterium granulosum* (referred to herein as P. granulosum). In some embodiments, the at least one health-associated strain of bacteria is a strain of *Propionibacterium acnes* subsp. *defendens* (referred to herein as P. acnes subsp. *defendens*), In some embodiments, the at least one health-associated strain of bacteria is a strain of *Staphylococcus aureus*. In some embodiments, the at least one health-associated strain of bacteria is a strain of *Staphylococcus epidermidis*. In some embodiments, the at least one health-associated strain of bacteria is a strain of *Staphylococcus hominis*. In some embodiments, the at least one health-associated strain of bacteria is a strain of *Lactobacillus reuteri*. In some embodiments, the strain of bacteria is associated with healthy skin or normal skin, and is referred to as a probiotic (or live biologic therapeutic). In some embodiments, the probiotic is associated with skin that is free of acne. In some embodiments, the probiotic is associated with skin that is essentially free of acne.

Provided herein are compositions that comprise at least one probiotic disclosed herein. In some embodiments, a probiotic disclosed herein is selected or assessed for a composition for treatment by assessing an amount of inflammation that is caused by the probiotic to the skin of a subject. In some embodiments, the probiotic produces or induces a low amount of pro-inflammatory mediators when applied to a subject's skin. In some embodiments, the probiotic produces or induces a low amount of pro-inflammatory mediators when applied to a subject's skin. In some embodiments, the probiotic does not produce or induce pro-inflammatory mediators when applied to a subject's skin. In some embodiments, the probiotic does not produce or induce pro-inflammatory mediators when applied to a subject's skin. In some embodiments, the probiotic does not produce or induce an amount of pro-inflammatory mediators sufficient to cause acne of a subject when applied to a subject's skin. In some embodiments, the probiotic does not produce or induce an amount of pro-inflammatory mediators sufficient to worsen acne of a subject when applied to a subject's skin. The probiotic may not induce human inflammatory associated mRNAs such as interleukins, chemokine or cytokines when applied to a subject's skin. The probiotic may induce only low amounts of human inflammatory associated mRNAs such as interleukins, chemokine or cytokines, when applied to a subject's skin.

In some embodiments, a probiotic disclosed herein is selected or assessed by incubating a sample of keratinocytes with the probiotic. In some embodiments, the probiotic produces or induces a low amount of pro-inflammatory mediators when co-incubated with a subject's keratinocytes. In some embodiments, the probiotic produces or induces a low amount of pro-inflammatory mediators when co-incubated with skin keratinocytes that are pooled from multiple subjects. In some embodiments, the probiotic does not produce or induce pro-inflammatory mediators when co-incubated with a subject's keratinocytes. In some embodiments, the probiotic does not produce or induce pro-inflammatory mediators when co-incubated with skin keratinocytes pooled from multiple subjects (e.g., "pooled skin keratinocytes"). In some embodiments, the probiotic comprises does not produce or induce an amount of pro-inflammatory mediators sufficient to cause acne of a subject when co-incubated with the subject's keratinocytes or pooled skin keratinocytes. In some embodiments, the probiotic does not produce or induce an amount of pro-inflammatory mediators sufficient to worsen acne of a subject when co-incubated with a subject's keratinocytes or pooled skin keratinocytes. The probiotic may not induce human inflammatory associated mRNAs such as interleukins, chemokine or cytokines when incubated with a subjects own keratinocytes or pooled keratinocytes from a plurality of healthy volunteers. The probiotic may induce only low amounts of human inflammatory associated mRNAs such as interleukins, chemokine or cytokines, when incubated with a subjects own keratinocytes or pooled keratinocytes from a plurality of healthy volunteers. The probiotic may induce only low amounts of human inflammatory associated mRNAs or proteins such as interleukins, chemokine or cytokines, when incubated with primary human monocytes. In a certain embodiment, the inflammatory interleukin, chemokine or cytokine comprises IL-2, IL-12, or MCP-1. An exemplar assay for induction of IL-12 in monocytes by a bacterium can be found in U.S. Pat. No. 9,549,905.

Compositions disclosed herein may comprise a strain the produces low levels of at least one porphyrin. In some embodiments, the strain produces undetectable levels of the at least one porphyrin. Non-limiting examples of porphyrins include coproporphyrin III and protoporphyrin IX. In some embodiments, a low level of the at least one porphyrin is less than about 1 micromolar. In some embodiments, a low level of the at least one porphyrin is less than about 750 nanomolar. In some embodiments, a low level of the at least one porphyrin is less than about 500 nanomolar. In some embodiments, a low level of the at least one porphyrin is less than about 250 nanomolar. In some embodiments, a low level of the at least one porphyrin is less than about 200 nanomolar. In some embodiments, a low level of the at least one porphyrin is less than about 150 nanomolar. In some embodiments, a low level of the at least one porphyrin is less than about 100 nanomolar. In some embodiments, a low level of the at least one porphyrin is less than about 50 nanomolar. In some embodiments, a low level of the at least one porphyrin is less than about 10 nanomolar. In some embodiments, a low level of the at least one porphyrin is less than about 1 nanomolar. In some embodiments, the low level is a level measured in vitro. In some embodiments, the low level is a level measured in situ, due to fluorescent properties of porphyrins. In some embodiments, a strain is genetically modified to delete or mutate a nucleic acid encoding an enzyme in a porphyrin production pathway to effectively create or select for strains with low porphyrin production. In some embodiments, the strain has low lipase activity as compared to a pathogenic strain of bacteria. In some embodiments, the strain has low immunogenicity as compared to a pathogenic strain of bacteria.

Disclosed herein are pharmaceutical compositions that comprise: (a) a first therapeutically effective amount of a first health-associated *Propionibacterium* microbe, wherein the first health-associated *Propionibacterium* microbe produces less than about one micromolar porphyrin; (b) a second therapeutically effective amount of a second health-associated microbe; and (c) a pharmaceutically acceptable excipient or biological stabilizer. Further disclosed herein are pharmaceutical compositions that consist essentially of: (a) a first therapeutically effective amount of a first health-associated *Propionibacterium* microbe, wherein the first health-associated *Propionibacterium* microbe produces less than about one micromolar porphyrin; (b) a second therapeutically effective amount of a second health-associated microbe; (c) a pharmaceutically acceptable excipient or biological stabilizer; and (d) optionally, an additional active ingredient disclosed herein. In some embodiments, the second health-associated microbe comprises a strain of *Propionibacterium*. In some embodiments, the concentration of porphyrin is a concentration measured in vitro. In some embodiments, the concentration of porphyrin is a concentration measured in situ. For example, porphyrin concentration can be measured directly on skin of a subject using light of a wavelength around 400 nm, a camera that detects fluorescence, and digital imaging software that quantifies fluorescence. In some embodiments, light of a wavelength between 300 and 900 nm is used.

In some embodiments, the first health-associated microbe produces less than about one micromolar porphyrin In some embodiments, the second health-associated microbe produces less than about one micromolar porphyrin.

In some embodiments, the first health-associated *Propionibacterium* microbe and the second health-associated *Propionibacterium* microbe collectively produce less than about one micromolar porphyrin. In some embodiments, the first health-associated *Propionibacterium* microbe and the second health-associated *Propionibacterium* microbe collectively produce less than about 800 nanomolar porphyrin. In some embodiments, the first health-associated *Propionibacterium* microbe and the second health-associated *Propionibacterium* microbe collectively produce less than about 500 nanomolar porphyrin. In some embodiments, the first health-associated *Propionibacterium* microbe and the second health-associated *Propionibacterium* microbe collectively produce less than about 200 nanomolar porphyrin. In some embodiments, the first health-associated *Propionibacterium* microbe and the second health-associated *Propionibacterium* microbe collectively produce less than about 100 nM porphyrin. In some embodiments, the first health-associated *Propionibacterium* microbe and the second health-associated *Propionibacterium* microbe collectively produce less than about 10 nM porphyrin.

In some embodiments, the first health-associated *Propionibacterium* microbe comprises a strain of *Propionibacterium acnes, Propionibacterium granulosum, Propionibacterium avidum,* or *Propionibacterium acnes* subsp. *defendens*. In some embodiments, the second health-associated *Propionibacterium* microbe comprises a strain of *Propionibacterium acnes, Propionibacterium granulosum, Propionibacterium avidum,* or *Propionibacterium acnes* subsp. *defendens*. In some embodiments, the first health-associated *Propionibacterium* microbe comprises a strain of *Propionibacterium acnes*. In some embodiments, the second health-associated *Propionibacterium* microbe comprises a strain of *Propionibacterium acnes*. In some embodiments, the first health-associated *Propionibacterium* microbe comprises a *Propionibacterium acnes* of a ribotype RT1 or RT2. In some embodiments, the second health-associated *Propionibacterium* microbe comprises a *Propionibacterium acnes* of a ribotype RT1 or RT2. In some embodiments, the first health-associated *Propionibacterium* microbe: (a) comprises at least one gene encoding an ATP binding cassette transporter; (b) comprises at least one gene encoding at least one of a deoxyribose operon repressor and a type II lipase, and less than about 10% pIMPLE plasmid; or (c) lacks at least one gene encoding a DNA binding response regulator or a phosphoglycerate kinase. In some embodiments, the second health-associated *Propionibacterium* microbe: (a) comprises at least one gene encoding an ATP binding cassette transporter; (b) comprises at least one gene encoding at least one of a deoxyribose operon repressor and a type II lipase, and less than about 10% pIMPLE plasmid; or (c) lacks at least one gene encoding a DNA binding response regulator or a phosphoglycerate kinase.

Probiotic strains disclosed herein may be defined by 16S, 18S, or 23S ribosomal DNA sequences, metagenomic DNA, the presence of specific health-associated markers, the absence of disease associated markers, or a combination thereof. Probiotic strains disclosed herein may be enriched or isolated to obtain a purified strain.

Provided herein are compositions comprising not more than one isolated strain of bacteria disclosed herein. Provided herein are compositions comprising not more than two isolated strains of bacteria disclosed herein. Provided herein are compositions comprising not more than three isolated strains of bacteria disclosed herein. Provided herein are compositions comprising not more than four isolated strains of bacteria disclosed herein. Provided herein are compositions comprising not more than five isolated strains of bacteria disclosed herein. Provided herein are compositions comprising not more than six isolated strains of bacteria disclosed herein. Provided herein are compositions comprising not more than seven isolated strains of bacteria disclosed herein. Provided herein are compositions comprising not more than eight isolated strains of bacteria disclosed herein. Provided herein are compositions comprising not more than nine isolated strains of bacteria disclosed herein. Provided herein are compositions comprising not more than ten isolated strains of bacteria disclosed herein.

Probiotics disclosed herein may comprise at least one strain of bacteria that inhibits the activity of a pathogenic strain of *P. acnes*. In some embodiments, the probiotic is bacteriostatic or bactericidal for a pathogenic strain of *P. acnes*. In some embodiments, the probiotic reduces growth, re-growth or metabolism of the pathogenic strain of *P. acnes*. In certain embodiments, the probiotic reduces growth (or re-growth) of the pathogenic *P. acnes* by at least about 20% as compared to placebo/no probiotic. In certain embodiments, the probiotic reduces growth (or re-growth) of the pathogenic *P. acnes* by at least about 30%. In certain embodiments, the probiotic reduces growth (or re-growth) of the pathogenic *P. acnes* by at least about 40%. In certain embodiments, the probiotic reduces growth (or re-growth) of the pathogenic *P. acnes* by at least about 50%. In certain embodiments, the probiotic reduces growth (or re-growth) of the pathogenic *P. acnes* by at least about 60%. In certain embodiments, the probiotic reduces growth (or re-growth) of the pathogenic *P. acnes* by at least about 70%. In certain embodiments, the probiotic reduces growth (or re-growth) of the pathogenic *P. acnes* by at least about 2-fold. In certain embodiments, the probiotic reduces growth (or re-growth) of the pathogenic *P. acnes* by at least about 3-fold. In certain embodiments, the probiotic reduces growth (or re-growth) of the pathogenic *P. acnes* by at least about 5-fold. In certain embodiments, the probiotic reduces growth (or re-growth) of the pathogenic *P. acnes* by at least about 10-fold. Inhibition or reduction of growth (or re-growth) of the pathogenic *P. acnes* may be assessed in an in vitro assay, either in liquid culture or on solid media.

In some embodiments, the probiotic comprises at least one healthy *P. acnes* strain. In some embodiments, the probiotic comprises not more than one healthy *P. acnes* strain. In some embodiments, the probiotic comprises at least two healthy *P. acnes* strains. In some embodiments, the at least one healthy *P. acnes* strain is not a strain of *P. acnes* subsp. *acnes*. In some embodiments, the probiotic comprises at least one healthy *P. avidum* strain. In some embodiments, the probiotic comprises not more than one healthy *P. avidum* strain. In some embodiments, the probiotic comprises at least two healthy *P. avidum* strains. In some embodiments, the probiotic comprises at least one healthy *P. granulosum* strain. In some embodiments, the probiotic comprises not more than one healthy *P. granulosum* strain. In some embodiments, the probiotic comprises at least two healthy *P. granulosum* strains. In some embodiments, the probiotic comprises at least one healthy *P. acnes* subsp. *defendens* strain. In some embodiments, the probiotic comprises not more than one healthy *P. acnes* subsp. *defendens* strain. In some embodiments, the probiotic comprises at least two healthy *P. acnes* subsp. *defendens* strains.

*P. acnes* strains may be characterized by a ribotype (RT). Ribotypes are defined, for example, as in Fitz-Gibbon et al., J. Investigative Dermatology 133:2152-60 (2013). A ribotype can be determined by the nucleic acid sequence of the strain's 16S ribosomal subunit. In certain embodiments, the probiotic comprises healthy *P. acnes* of a ribotype selected from at least one of the following ribotypes of RT1, RT2, RT3, RT4, RT5, RT7, RT8, RT9, or RT10. In certain embodiments, the probiotic comprises healthy *P. acnes* of a ribotype selected from at least one of the following ribotypes of RT1, RT2, RT3, RT7, RT8, RT9, or RT10. In certain embodiments, the probiotic comprises healthy *P. acnes* of a ribotype selected from RT1 and RT2. In some instances, the probiotic does not comprise a *P. acnes* strain of ribotype RT6. In some instances, the probiotic does not comprise a *P. acnes* strain of a ribotype selected from RT3, RT4, RT5 and RT6. In some instances, the probiotic does not comprise a *P. acnes* strain of ribotype RT6. In some instances, the probiotic does not comprise a *P. acnes* strain of a ribotype selected from RT3, RT4, and RT5. In some embodiments, compositions disclosed herein comprise a strain of *P. acnes* of ribotype RT1. In some embodiments, compositions disclosed herein comprise a strain of *P. acnes* of ribotype RT2. In some embodiments, compositions disclosed herein comprise a strain of *P. acnes* of ribotype RT3. In some embodiments, compositions disclosed herein comprise a strain of *P. acnes* of ribotype RT4. In some embodiments, compositions disclosed herein comprise a strain of *P. acnes* of ribotype RT5. In some embodiments, compositions disclosed herein comprise a strain of *P. acnes* of ribotype RT6. In some embodiments, compositions disclosed herein comprise a strain of *P. acnes* of ribotype RT7. In some embodiments, compositions disclosed herein comprise a strain of *P. acnes* of ribotype RT8. In some embodiments, compositions disclosed herein comprise a strain of *P. acnes* of ribotype RT9. In some embodiments, compositions disclosed herein comprise a strain of *P. acnes* of ribotype RT10. In certain embodiments, the probiotic comprises a strain of *P. acnes* of a ribotype selected from at least one of RT1, RT2, and RT3. In certain embodiments, the probiotic comprises a *P. acnes* strain of ribotype RT1. In certain embodiments, the probiotic comprises a *P. acnes* strain of ribotype RT2. In certain embodiments, the probiotic comprises a *P. acnes* strain of ribotype RT3. In certain embodiments, the probiotic comprises a *P. acnes* strain of ribotype RT3. In certain embodiments, the probiotic does not comprise an RT6 ribotype.

In certain embodiments, the probiotic does not comprise a strain with a nucleic acid having a sequence that is 95%, 97%, 98%, 99% or 100% homologous to a sequence selected from SEQ ID NO: 51, SEQ ID NO: 52, SEQ ID NO: 53, and SEQ ID NO: 54. In certain embodiments, the probiotic does not comprise a strain with a nucleic acid having a sequence that is more than 50% homologous to a sequence selected from SEQ ID NO: 51, SEQ ID NO: 52, SEQ ID NO: 53, and SEQ ID NO: 54. In certain embodiments, the probiotic does not comprise a strain with a nucleic acid having a sequence selected from SEQ ID NO: 51, SEQ ID NO: 52, SEQ ID NO: 53.

In certain embodiments, probiotics disclosed herein comprise a plurality of microbes of different ribotypes. In certain embodiments, the plurality of microbes is a mixture of two or more *P. acnes* strains of different ribotypes. In certain embodiments, the probiotic comprises a first strain of *P. acnes* of ribotype RT1 and a second strain of *P. acnes* of ribotype RT2. In certain embodiments, the probiotic comprises a first strain of *P. acnes* of ribotype RT1 and a second strain of *P. acnes* of ribotype RT3. In certain embodiments, the probiotic comprises a first strain of *P. acnes* of ribotype RT1 and a second strain of *P. acnes* is not ribotype RT6. In certain embodiments, the probiotic comprises a first strain of *P. acnes* of ribotype RT2 and a second strain of *P. acnes* of ribotype RT3. In certain embodiments, the probiotic comprises a first strain of *P. acnes* of ribotype RT2 and a second strain of *P. acnes* is not ribotype RT6. In certain embodiments, the probiotic comprises a first strain of *P. acnes* of ribotype RT2 and a second strain of *P. acnes* of ribotype RT3. In certain embodiments, the probiotic consists essentially of a first strain of *P. acnes* of ribotype RT1 and a second strain of *P. acnes* of ribotype RT2. In certain embodiments, the probiotic consists essentially of a first strain of *P. acnes* of ribotype RT1 and a second strain of *P. acnes* of ribotype RT3. In certain embodiments, the probiotic consists essentially of a first strain of *P. acnes* of ribotype RT1 and a second strain of *P. acnes* is not ribotype RT6. In certain embodiments, the probiotic consists essentially of a first strain of *P. acnes* of ribotype RT2 and a second strain of *P. acnes* of ribotype RT3. In certain embodiments, the probiotic consists essentially of a first strain of *P. acnes* of ribotype RT2 and a second strain of *P. acnes* is not ribotype RT6. In certain embodiments, the probiotic consists essentially of a first strain of *P. acnes* of ribotype RT2 and a second strain of *P. acnes* of ribotype RT3. In some embodiments, the first strain of *P. acnes* and the second strain of *P. acnes* are provided separately. In some embodiments, the first strain of *P. acnes* and second strain of *P. acnes* are mixed.

In some embodiments, probiotics disclosed herein comprise a health-associated *P. acnes* strain that is ribotype RT1, deoR-positive, type II lipase-positive, does not comprise Cas5, and has less than 5% pIMPLE plasmid. In some embodiments, deoR-positive means that the strain comprises a nucleic acid encoding deoR. In some embodiments, deoR-positive means that the strain comprises a deoR protein. In some embodiments, type II lipase-positive means that the strain comprises a nucleic acid encoding type II lipase. In some embodiments, type II lipase-positive means that the strain comprises a type II lipase protein. In some embodiments, the strain does not comprise a nucleic acid encoding a Cas 5 protein. In some embodiments, probiotics disclosed herein comprise a health-associated *P. acnes* strain that is ribotype RT2, deoR-positive, type II lipase-positive, Cas5-positive and has less than 5% pIMPLE plasmid.

In certain embodiments, the probiotic is a plurality of microbes of different ribotypes. In certain embodiments, the plurality of microbes comprises a mixture of three or more *P. acnes* strains of different ribotypes. In certain embodiments, the different ribotypes are RT1, RT2, and RT3. In certain embodiments, the different ribotypes are RT2, RT3, and not RT6. In certain embodiments, the different ribotypes are RT1, RT2, and not RT6. In certain embodiments, the different ribotypes are RT1, RT3, and not RT6. In certain embodiments, the mixture consists essentially of three *P.*

*acnes* strains, wherein the three *P. acnes* strains are of ribotypes RT1, RT2, and RT3. In certain embodiments, the mixture consists essentially of three *P. acnes* strains, wherein the three *P. acnes* strains are of ribotypes RT2, RT3, and not RT6. In certain embodiments, the mixture consists essentially of three *P. acnes* strains, wherein the three *P. acnes* strains are of ribotypes RT1, RT2, and not RT6. In certain embodiments, the mixture consists essentially of three *P. acnes* strains, wherein the three *P. acnes* strains are of ribotypes RT1, RT3, and not RT6.

In some embodiments, probiotics disclosed herein comprise at least one health-associated strain of *P. acnes*, wherein the health-associated strain of *P. acnes* has a ribotype of RT1 or RT2. In some embodiments, probiotics disclosed herein comprise at least two health-associated strains of *P. acnes*, wherein a first health-associated strain of *P. acnes* has a ribotype of RT1 and a second health-associated strain of *P. acnes* has a ribotype of RT2. In some embodiments, probiotics disclosed herein do not comprise a strain of *P. acnes*, other than a health-associated strain of *P. acnes* disclosed herein that has a ribotype selected from RT1 and RT2. In some embodiments, the probiotic does not comprise a strain of *P. acnes* that has a ribotype RT6. In some embodiments, the probiotic does not comprise a strain of *P. acnes* that comprises a nucleic acid encoding a DNA binding response regulator or a phosphoglycerate kinase, as described herein. In some embodiments, the probiotic comprises a strain of *P. acnes* comprising a nucleic acid encoding an ATP binding cassette transporter, as described herein. In some embodiments, the probiotic does not comprise a strain of *P. acnes* that expresses DNA binding response regulator or phosphoglycerate kinase, as described herein. In some embodiments, the probiotic comprises a strain of *P. acnes* that expresses an ATP binding cassette transporter, as described herein.

In some embodiments, probiotics disclosed herein comprise at least one strain of bacteria that can be identified by a genetic signature. The genetic signature can be described as one or more genes that are at least present, and optionally expressed, in a strain of bacteria. The one or more genes may comprise a gene encoding a deoxyribose operon repressor (deoR). The one or more genes may encode a type I lipase. The one or more genes may encode a type II lipase. The one or more genes may encode Cas 5. In some instances, the one or more genes do not comprise a gene encoding a deoxyribose operon repressor (gene abbreviated deoR, protein abbreviated herein as deoR). In some instances, the one or more genes do not comprise a gene encoding a type I lipase. In some instances, the one or more genes do not comprise a gene encoding a type II lipase. In some instances, the one or more genes do not comprise a gene encoding a Cas5 protein.

In some embodiments, probiotics disclosed herein comprise at least one strain of bacteria expressing a type II lipase. In some embodiments, probiotics disclosed herein comprise at least one strain of bacteria expressing a deoR and a type II lipase. In some embodiments, probiotics disclosed herein comprise at least one strain of bacteria expressing a Cas5 and a type II lipase. In some embodiments, probiotics disclosed herein comprise at least one strain of bacteria expressing a deoR and a type II lipase and a Cas5.

In some embodiments, compositions disclosed herein comprise at least one strain of bacteria, wherein less than about 25% of a number of reads align per number of reads tested when the reads from sequencing the strain are aligned to a pIMPLE plasmid. In some embodiments, compositions disclosed herein comprise at least one strain of bacteria, wherein less than about 20% of a number of reads align per number of reads tested when the reads from sequencing the strain are aligned to a pIMPLE plasmid. In some embodiments, compositions disclosed herein comprise at least one strain of bacteria, wherein less than about 15% of a number of reads align per number of reads tested when the reads from sequencing the strain are aligned to a pIMPLE plasmid. In some embodiments, compositions disclosed herein comprise at least one strain of bacteria, wherein less than about 10% of a number of reads align per number of reads tested when the reads from sequencing the strain are aligned to a pIMPLE plasmid. In some embodiments, compositions disclosed herein comprise at least one strain of bacteria, wherein less than about 9% of a number of reads align per number of reads tested when the reads from sequencing the strain are aligned to a pIMPLE plasmid. In some embodiments, compositions disclosed herein comprise at least one strain of bacteria, wherein less than about 8% of a number of reads align per number of reads tested when the reads from sequencing the strain are aligned to a pIMPLE plasmid. In some embodiments, compositions disclosed herein comprise at least one strain of bacteria, wherein less than about 7% of a number of reads align per number of reads tested when the reads from sequencing the strain are aligned to a pIMPLE plasmid. In some embodiments, compositions disclosed herein comprise at least one strain of bacteria, wherein less than about 6% of a number of reads align per number of reads tested when the reads from sequencing the strain are aligned to a pIMPLE plasmid. In some embodiments, compositions disclosed herein comprise at least one strain of bacteria, wherein less than about 5% of a number of reads align per number of reads tested when the reads from sequencing the strain are aligned to a pIMPLE plasmid. In some embodiments, compositions disclosed herein comprise at least one strain of bacteria, wherein less than about 4% of a number of reads align per number of reads tested when the reads from sequencing the strain are aligned to a pIMPLE plasmid. In some embodiments, compositions disclosed herein comprise at least one strain of bacteria, wherein less than about 3% of a number of reads align per number of reads tested when the reads from sequencing the strain are aligned to a pIMPLE plasmid. In some embodiments, compositions disclosed herein comprise at least one strain of bacteria, wherein less than about 2% of a number of reads align per number of reads tested when the reads from sequencing the strain are aligned to a pIMPLE plasmid. In some embodiments, compositions disclosed herein comprise at least one strain of bacteria, wherein less than about 1% of a number of reads align per number of reads tested when the reads from sequencing the strain are aligned to a pIMPLE plasmid. In some embodiments, compositions disclosed herein comprise at least one strain of bacteria, wherein less than about 0.5% of a number of reads align per number of reads tested when the reads from sequencing the strain are aligned to a pIMPLE plasmid.

In some embodiments, the composition comprises a strain of bacteria that is ribotype RT1, expresses type I lipase, and does not express deoR and Cas5, and wherein less than 5% of a number of reads align to pIMPLE plasmid per number of reads tested from whole genome sequencing of the strain. In some embodiments, the composition comprises a strain of bacteria that is ribotype RT1, expresses deoR and type I lipase, and does not express Cas5, and wherein less than 5% of a number of reads align to pIMPLE plasmid per number of reads tested from whole genome sequencing of the strain. In some embodiments, the composition comprises a strain of bacteria that is ribotype RT1, expresses deoR and type II lipase, and does not express Cas5, and wherein less than 5% of a number of reads align to pIMPLE plasmid per number of reads tested from whole genome sequencing of the strain. In some embodiments, the composition comprises a strain of bacteria that is ribotype RT2, expresses deoR, type II lipase, and Cas5, and wherein less than 5% of a number of reads align to pIMPLE plasmid per number of reads tested from whole genome sequencing of the strain. In some embodiments, the composition comprises a strain of bacteria that is ribotype RT4 and expresses type I lipase, but not deoR. In some embodiments, the composition comprises a strain of bacteria that is not ribotype RT6, expresses deoR, type II lipase, and Cas5, and wherein less than 5% of a number of reads align to pIMPLE plasmid per number of reads tested from whole genome sequencing of the strain.

In some embodiments, the composition comprises a strain of bacteria that is ribotype RT1, comprises a nucleic acid encoding type I lipase, and does not comprises a nucleic acid encoding deoR or Cas5, and wherein less than 5% of a number of reads align to pIMPLE plasmid per number of reads tested from whole genome sequencing of the strain. In some embodiments, the composition comprises a strain of bacteria that is ribotype RT1, comprises at least one nucleic acid encoding deoR and type I lipase, does not comprise a nucleic acid encoding Cas5, and wherein less than 5% of a number of reads align to pIMPLE plasmid per number of reads tested from whole genome sequencing of the strain. In some embodiments, the composition comprises a strain of bacteria that is ribotype RT1, a nucleic acid encoding deoR and type II lipase, does not comprise a nucleic acid encoding Cas5, and wherein less than 5% of a number of reads align to pIMPLE plasmid per number of reads tested from whole genome sequencing of the strain. In some embodiments, the composition comprises a strain of bacteria that is ribotype RT2, comprises at least one nucleic acid encoding deoR, type II lipase, and Cas5, and wherein less than 5% of a number of reads align to pIMPLE plasmid per number of reads tested from whole genome sequencing of the strain. In some embodiments, the composition comprises a strain of bacteria that is ribotype RT4 and comprises a nucleic acid encoding type I lipase, but does not comprise a nucleic acid encoding deoR. In some embodiments, the composition comprises a strain of bacteria that is not ribotype RT6, comprises at least one nucleic acid encoding deoR, type II lipase, and Cas5, and wherein less than 5% of a number of reads align to pIMPLE plasmid per number of reads tested from whole genome sequencing of the strain.

Table 1 below provides a summary of non-limiting examples of *P. acnes* bacteria, or populations of bacteria comprising *P. acnes* bacteria, that can be distinguished by analysis of different genetic markers. The + symbol indicates the presence of deoR or Cas5 (or nucleic acids encoding deoR or Cas5) in the columns labeled deoR and Cas5, respectively. The − symbol indicates absence of deoR or Cas5 (or nucleic acids encoding deoR or Cas5) in the columns labeled deoR and Cas5, respectively. % pIMPLE plasmid refers to the number of reads aligned/number of reads tested when bacteria is sequenced for pIMPLE plasmid.

TABLE 1

Sequences of *P. acnes* genetic elements.

| Group | RT | deoR | Lipase | Cas 5 | % pIMPLE plasmid | ABC XP | DBRR | PGK | Exemplary strains |
|---|---|---|---|---|---|---|---|---|---|
| A | 1 | − | I | − | <5% | + | − | − | |
| B | 1 | + | I | − | <5% | + | − | − | |
| C | 1 | + | II | − | <5% | + | − | − | HP3A11 |
| D | 2 | + | II | + | <5% | + | − | − | HP4G1, HP5G4 |
| E | 4 | − | I | − | >1% | + | − | − | HL045PA1 |
| F | 5 | − | I | − | >1% | + | − | − | HL043PA1 |
| G | 6 | + | II | + | >5% | − | + | + | HL110PA3, HL110PA4 |

ABC XP = ATP binding cassette transporter
DBRR = DNA binding response regulator
PGK = phosphoglycerate kinase In certain embodiments, the composition comprises at least one strain of a *P. acnes* microbe that corresponds to group A of Table 1. In certain embodiments, the composition comprises at least one strain of a *P. acnes* microbe that corresponds to group B of Table 1. In certain embodiments, the composition comprises at least one strain of a *P. acnes* microbe that corresponds to group C of Table 1. In certain embodiments, the composition comprises at least one strain of a *P. acnes* microbe that corresponds to group D of Table 1.

In certain embodiments, the composition comprises at least one strain of a *P. acnes* microbe that corresponds to groups A, B, C or D of Table 1. In certain embodiments, the composition comprises at least two strains of a *P. acnes* microbe that correspond to groups A, B, C or D of Table 1. In certain embodiments, the composition comprises at least three strains of a *P. acnes* microbe that correspond to groups A, B, C or D of Table 1. In certain embodiments, the composition comprises at least four strains of a *P. acnes* microbe that correspond to groups A, B, C or D of Table 1. In certain embodiments, the composition comprises at least five strains of a *P. acnes* microbe that correspond to groups A, B, C, or D of Table 1.

In some embodiments, the composition does not comprise a strain of *P. acnes* that corresponds to group E of Table 1. In some embodiments, the composition does not comprise a strain of *P. acnes* that corresponds to group F of Table 1. In some embodiments, the composition does not comprise a strain of *P. acnes* that corresponds to group G of Table 1.

In some embodiments, the composition comprises at least one strain of *P. acnes* that corresponds to group A of Table 1, but does not comprise a strain of *P. acnes* that corresponds to groups E, F or G of Table 1. In some embodiments, the composition comprises at least one strain of *P. acnes* that corresponds to group B of Table 1, but does not comprise a strain of *P. acnes* that corresponds to groups E, F or G of Table 1. In some embodiments, the composition comprises at least one strain of *P. acnes* that corresponds to group C of Table 1, but does not comprise a strain of *P. acnes* that corresponds to groups E, F or G of Table 1. In some embodiments, the composition comprises at least one strain of *P. acnes* that corresponds to group D of Table 1, but does not comprise a strain of *P. acnes* that corresponds to groups E, F or G of Table 1. In some embodiments, the composition comprises at least one strain of *P. acnes* that corresponds to group C of Table 1 and at least one strain of *P. acnes* that corresponds to group D of Table 1, but does not comprise a strain of *P. acnes* that corresponds to groups E, F or G of Table 1.

Health-Associated Microbes

Provided herein are compositions for treating and preventing skin disorders, wherein the compositions comprise a health-associated microbe. Generally, the term, "health-associated microbe," as used herein, refers to a microbe that is more prevalent in healthy or individuals free of a skin disease than in individuals diagnosed with the skin disease. In some embodiments, health-associated microbes disclosed herein are associated with desirable or optimal oral health. In some embodiments, health-associated microbes disclosed herein are associated with desirable or optimal gastrointestinal health.

Health-associated microbes include probiotics described herein. Health-associated microbes include healthy *P. acnes* described herein. In some embodiments, health-associated microbes are microbes that can replace at least a portion of pathogenic microbes. In some embodiments, health-associated microbes are microbes that can alter a microbiome to increase a percentage of health associated strains. In some embodiments, health-associated microbes inhibit the growth of pathogenic microbes or disease associated microbes. In some embodiments, health-associated microbes out-compete pathogenic or disease associated microbes. In certain embodiments, the skin disorder is selected from at least one of acne vulgaris (acne), eczema, seborrheic dermatitis, psoriasis, or rosacea. In some embodiments, the skin disorder is acne.

In certain embodiments, health-associated microbes disclosed herein are associated with desirable health, optimal health or improved health relative to the health of a subject with a disease, disorder or condition disclosed herein. Desirable health, optimal health or improved health may be characterized as free of a condition, disorder or disease. Desirable health, optimal health or improved health may be characterized as free of one or more symptoms of a condition, disorder or disease. Desirable health, optimal health or improved health may be characterized as free of all symptoms of a condition, disorder or disease. Desirable health, optimal health or improved health may be characterized as improved health relative to health with a disease, disorder or condition. In certain embodiments, the health-associated microbe is associated with optimal, desirable or improved skin health. In certain embodiments, the health-associated microbe is associated with optimal, desirable or improved oral health. In certain embodiments, the health-associated microbe is associated with optimal, desirable or improved digestive health. In certain embodiments, the health-associated microbe is a *P. acnes* strain associated with skin health, oral health, digestive health, or any combination thereof, that is optimal, desirable or improved relative to respective health associated with a condition, disorder or disease.

In certain embodiments, there is a statistically significant difference in the presence of the health-associated microbe on the skin of an individual free of a disease when compared to an individual with the disease. In certain embodiments, there is at least about a 10% greater quantity of a health-associated microbe on the skin of an individual free of a disease when compared to an individual with the disease. In certain embodiments, there is at least about a 50% greater quantity of a health-associated microbe on the skin of an individual free of a disease when compared to an individual with the disease. In certain embodiments, there is at least about a 100% greater quantity of a health-associated microbe on the skin of an individual free of a disease when compared to an individual with the disease. In certain embodiments, there is at least about a 2-fold greater presence of the health-associated microbe on the skin of an individual free of a disease when compared to an individual with the disease. In certain embodiments, there is at least about a 3-fold greater presence of the health-associated microbe on the skin of an individual free of a disease when compared to an individual with the disease. In certain embodiments, there is at least about a 5-fold greater presence of the health-associated microbe on the skin of an individual free of a disease when compared to an individual with the disease. In certain embodiments, there is at least about a 10-fold greater presence of the health-associated microbe on the skin of an individual free of a disease when compared to an individual with the disease.

In certain embodiments, the health-associated microbe is an isolated species of bacteria. In certain embodiments, the health-associated microbe is a purified species of bacteria. In certain embodiments, the health-associated microbe is an isolated and purified species of bacteria. In certain embodiments, the health-associated microbe is an isolated strain of bacteria. In certain embodiments, the health-associated microbe is a purified strain of bacteria. In certain embodiments, the health-associated microbe is an isolated and purified strain of bacteria. In certain embodiments, the health-associated microbe is an isolated species of *Propionibacterium*. In certain embodiments, the health-associated microbe is a purified species of *Propionibacterium*. In certain embodiments, the health-associated microbe is an isolated and purified species of *Propionibacterium*. In certain embodiments, the health-associated microbe is an isolated strain of *P. acnes*. In certain embodiments, the health-associated microbe is a purified strain of *P. acnes*. In certain embodiments, the health-associated microbe is an isolated and purified strain of *P. acnes*.

As described herein, some strains of *P. acnes* are associated with acne and some strains of *P. acnes* are associated with skin free of acne or disease. These *P. acnes* strains can be differentiated at the genetic level by using nucleic acid sequence determination methods known in the art such as PCR, restriction mapping, Sanger sequencing, and next-generation sequencing. In some instances, a health-associated microbe disclosed herein is beneficial for the treatment of a specific skin disorder, but not all skin disorders. In some instances, a health-associated microbe disclosed herein is beneficial for the treatment of a plurality of skin disorder, but not all skin disorders. In some instances, a health-associated microbe disclosed herein is beneficial for the treatment any skin disorder. By way of non-limiting example, a health-associated microbe disclosed herein may be beneficial only for acne, but not for eczema, seborrheic dermatitis, or psoriasis. In another instance, a health-associated microbe disclosed herein is beneficial only for eczema, but not for acne, seborrheic dermatitis, or psoriasis. In another instance, a health-associated microbe disclosed herein is beneficial only for psoriasis, but not for acne, seborrheic dermatitis, or eczema. In another instance, a health-associated microbe disclosed herein is beneficial only for seborrheic dermatitis, but not for psoriasis, acne, or eczema. In some instances, a health-associated microbe disclosed herein is beneficial for eczema, acne and psoriasis. In some instances, a health-associated microbe disclosed herein is beneficial for acne and a condition selected from eczema, seborrheic dermatitis. In some instances, a health-associated microbe disclosed herein is beneficial for eczema, seborrheic dermatitis, acne and psoriasis.

In certain embodiments, compositions disclosed herein comprise at least one health-associated microbe, wherein the health-associated microbe is a strain of *P. acnes* or bacteria that is associated with healthy or normal skin. In certain embodiments, compositions disclosed herein comprise at least one health-associated microbe, wherein the health-associated microbe is a strain of *P. acnes* or bacteria that produces low levels of inflammatory mediators when incubated with a subject's own keratinocytes or pooled keratinocytes from multiple subjects.

In certain embodiments, compositions comprise an isolated *Propionibacterium* strain. In some embodiments the isolated *Propionibacterium* strain is a purified strain. In certain embodiments, compositions comprise a mixture of about 2 to about 10 isolated *Propionibacterium* strains. In certain embodiments, compositions comprise a mixture of about 3 to about 8 isolated *Propionibacterium* strains. In certain embodiments, compositions comprise a mixture of about 2 to about 5 isolated *Propionibacterium* strains. In certain embodiments, compositions comprise a mixture of about 3 to about 6 isolated *Propionibacterium* strains. In certain embodiments, the isolated *Propionibacterium* strain is isolated based on its phylotype or ribotype. *Propionibacterium* strains are disclosed throughout the instant specification.

In certain embodiments, compositions consist essentially of an isolated *Propionibacterium* strain and a pharmaceutically acceptable excipient or biological stabilizer. In certain embodiments, compositions consist essentially of two isolated *Propionibacterium* strains and a pharmaceutically acceptable excipient or biological stabilizer. In some embodiments the isolated *Propionibacterium* strain is a purified strain. In certain embodiments, compositions consist essentially of about 2 to about 10 isolated *Propionibacterium* strains, and a pharmaceutically acceptable excipient or biological stabilizer disclosed herein. In certain embodiments, compositions consist essentially of about 3 to about 8 isolated *Propionibacterium* strains, and a pharmaceutically acceptable excipient or biological stabilizer disclosed herein. In certain embodiments, compositions consist essentially of about 2 to about 5 isolated *Propionibacterium* strains, and a pharmaceutically acceptable excipient or biological stabilizer disclosed herein. In certain embodiments, compositions consist essentially of about 3 to about 6 isolated *Propionibacterium* strains, and a pharmaceutically acceptable excipient or biological stabilizer disclosed herein. In certain embodiments, the isolated strain is isolated based on its phylotype or ribotype. Exemplary *Propionibacterium* strains and a pharmaceutically acceptable excipient or biological stabilizer are described throughout the instant specification.

In certain embodiments, compositions consist essentially of an isolated *Propionibacterium* strain, a pharmaceutically acceptable excipient or biological stabilizer, and at least one additional active ingredient disclosed herein. In certain embodiments, compositions consist essentially of two isolated *Propionibacterium* strains, a pharmaceutically acceptable excipient or biological stabilizer, and at least one additional active ingredient disclosed herein. In some embodiments the isolated *Propionibacterium* strain is a purified strain. In certain embodiments, compositions consist essentially of about 2 to about 10 isolated *Propionibacterium* strains, a pharmaceutically acceptable excipient or biological stabilizer, and at least one additional active ingredient disclosed herein. In certain embodiments, compositions consist essentially of about 3 to about 8 isolated *Propionibacterium* strains, a pharmaceutically acceptable excipient or biological stabilizer, and at least one additional active ingredient disclosed herein. In certain embodiments, compositions consist essentially of about 2 to about 5 isolated *Propionibacterium* strains, a pharmaceutically acceptable excipient or biological stabilizer, and at least one additional active ingredient disclosed herein. In certain embodiments, compositions consist essentially of about 3 to about 6 isolated *Propionibacterium* strains, a pharmaceutically acceptable excipient or biological stabilizer, and at least one additional active ingredient disclosed herein. In certain embodiments, the isolated strain is isolated based on its phylotype or ribotype. Exemplary *Propionibacterium* strains and a pharmaceutically acceptable excipient or biological stabilizer are described throughout the instant specification.

In certain embodiments, compositions comprise an isolated *P. acnes* strain. In some embodiments the isolated *P. acnes* strain is a purified strain. In certain embodiments, compositions comprise a mixture of about 2 to about 10 isolated *P. acnes* strains. In certain embodiments, compositions comprise a mixture of about 3 to about 8 isolated *P. acnes* strains. In certain embodiments, compositions comprise a mixture of about 2 to about 5 isolated *P. acnes* strains. In certain embodiments, compositions comprise a mixture of about 3 to about 6 isolated *P. acnes* strains. In certain embodiments, the isolated *P. acnes* strain is isolated based on its phylotype or ribotype.

In certain embodiments, compositions consist essentially of an isolated *P. acnes* strain and a pharmaceutically acceptable excipient or biological stabilizer. In certain embodiments, compositions consist essentially of two isolated *P. acnes* strains and a pharmaceutically acceptable excipient or biological stabilizer. In some embodiments the isolated *P. acnes* strain is a purified strain. In certain embodiments, compositions consist essentially of about 2 to about 10 isolated *P. acnes* strains and a pharmaceutically acceptable excipient or biological stabilizer disclosed herein. In certain embodiments, compositions consist essentially of about 3 to about 8 isolated *P. acnes* strains and a pharmaceutically acceptable excipient or biological stabilizer disclosed herein. In certain embodiments, compositions consist essentially of about 2 to about 5 isolated *P. acnes* strains and a pharmaceutically acceptable excipient or biological stabilizer disclosed herein. In certain embodiments, compositions consist essentially of about 3 to about 6 isolated *P. acnes* strains and a pharmaceutically acceptable excipient or biological stabilizer disclosed herein. In certain embodiments, the isolated strain is isolated based on its phylotype or ribotype. Exemplary *P. acnes* strains and a pharmaceutically acceptable excipient or biological stabilizer are described throughout the instant specification.

In certain embodiments, compositions consist essentially of an isolated *P. acnes* strain, a pharmaceutically acceptable excipient or biological stabilizer, and at least one additional active ingredient disclosed herein. In certain embodiments, compositions consist essentially of two isolated *P. acnes* strains, a pharmaceutically acceptable excipient or biological stabilizer, and at least one additional active ingredient disclosed herein. In some embodiments the isolated *P. acnes* strain is a purified strain. In certain embodiments, compositions consist essentially of about 2 to about 10 isolated *P. acnes* strains, a pharmaceutically acceptable excipient or biological stabilizer, and at least one additional active ingredient disclosed herein. In certain embodiments, compositions consist essentially of about 3 to about 8 isolated *P. acnes* strain, a pharmaceutically acceptable excipient or biological stabilizer, and at least one additional active ingredient disclosed herein. In certain embodiments, compositions consist essentially of about 2 to about 5 isolated *P. acnes* strains and a pharmaceutically acceptable excipient or biological stabilizer disclosed herein, a pharmaceutically acceptable excipient or biological stabilizer, and at least one additional active ingredient disclosed herein. In certain embodiments, compositions consist essentially of about 3 to about 6 isolated *P. acnes* strain, a pharmaceutically acceptable excipient or biological stabilizer, and at least one additional active ingredient disclosed herein. In certain embodiments, the isolated strain is isolated based on its phylotype or ribotype. Exemplary *P. acnes* strains and a pharmaceutically acceptable excipient or biological stabilizer are described throughout the instant specification.

In certain embodiments, compositions disclosed herein comprise at least one *P. acnes* strain having a health-associated phylotype. In certain embodiments, the health-associated phylotype is selected from type I, type II, and type III. In some embodiments, compositions disclosed herein comprise at least two *P. acnes* strains having health-associated phylotypes, wherein the health-associated phylotypes are a combination of type I, type II, and type III. In certain embodiments, the type I phylotype is selected from type IA, type IB, and type IC. In certain embodiments, the type IA phylotype is selected from type $IA_1$ and type $IA_2$. Strains can be phylotyped as in McDowell et al. (PLoS ONE 8(9): e70897 (2013)).

In some embodiments, compositions disclosed herein comprise a combination of health-associated microbes, wherein the health-associated microbes comprise a combination of healthy strains of *P. acnes*. In some embodiments, combinations of healthy strains of *P. acnes* comprise a combination of strains of *P. acnes* of a plurality of ribotypes. In some embodiments, the plurality of ribotypes comprises at least two ribotypes selected from RT1, RT2, RT3, RT7, RT8, RT9, and RT10. In some embodiments, the plurality of ribotypes comprises at least two ribotypes selected from RT1, RT2 and RT3. In certain embodiments, the plurality of ribotypes comprises at least two ribotypes selected from RT1, RT2, RT3 and not RT6. In certain embodiments, the plurality of ribotypes comprises ribotypes selected from RT1 and RT2. In certain embodiments, the plurality of ribotypes comprises ribotypes selected from RT1 and RT3. In certain embodiments, the plurality of ribotypes comprises ribotypes selected from RT2 and RT3. In certain embodiments, the plurality of ribotypes comprises RT1, but not RT6. In certain embodiments, the plurality of ribotypes comprises RT2, but not RT6.

In some embodiments, compositions disclosed herein comprise a combination of health-associated microbes, wherein the health-associated microbes comprise a combination of healthy strains of *P. acnes*. In some embodiments, the combination comprises a first strain of *P. acnes* and a second strain of *P. acnes*. In some embodiments, the first strain of *P. acnes* is of a first ribotype and a second strain of *P. acnes* is of a second ribotype. In some embodiments, the first ribotype and the second ribotype are the same. In some embodiments, the first ribotype and the second ribotype are different. In some embodiments, the first ribotype is RT1 and the second ribotype is RT1. In some embodiments, the first ribotype is RT2 and the second ribotype is RT2. In some embodiments, the first ribotype is RT1 and the second ribotype is RT2. In some embodiments, the first ribotype is RT1 and the second ribotype is RT3. In some embodiments, the first ribotype is RT2 and the second ribotype is RT3. In some embodiments, the first ribotype is RT1 and the second ribotype is not RT6. In some embodiments, the first ribotype is RT2 and the second ribotype is not RT6. In some embodiments, the first ribotype is RT3 and the second ribotype is not RT6.

In some embodiments, compositions disclosed herein comprise healthy strains of *P. acnes*, and do not comprise any other type of microbe or bacteria. In some embodiments, health-associated microbes disclosed herein comprise at least one health-associated strain of *P. acnes*, wherein the health-associated strain of *P. acnes* has a ribotype of RT1 or RT2. In some embodiments, health-associated microbes disclosed herein do not comprise a strain of *P. acnes*, other than a health-associated strain of *P. acnes* disclosed herein that has a ribotype selected from RT1 and RT2. In some embodiments, the health-associated microbes do not comprise a strain of *P. acnes* that has a ribotype RT6. In some embodiments, the health-associated microbes do not comprise a strain of *P. acnes* that expresses DNA binding response regulator or phosphoglycerate kinase, as described herein. In some embodiments, the health-associated microbes comprise a strain of *P. acnes* that expresses an ATP binding cassette transporter, as described herein.

In certain embodiments, the health-associated microbe does not comprise a strain with a sequence that is 95%, 97%, 98%, 99% or 100% homologous to a sequence selected from SEQ ID NO: 51, SEQ ID NO: 52, SEQ ID NO: 53, and SEQ ID NO: 54. In certain embodiments, the health-associated microbe does not comprise a strain with a sequence that is more than 50% homologous to a sequence selected from SEQ ID NO: 51, SEQ ID NO: 52, SEQ ID NO: 53, and SEQ ID NO: 54. In certain embodiments, the health-associated microbe does not comprise a strain with a sequence selected from SEQ ID NO: 51, SEQ ID NO: 52, SEQ ID NO: 53.

In certain embodiments, compositions disclosed herein comprise a health-associated microbe, wherein the health-associated microbe is *Lactobacillus reuteri* (referred to herein as *L. reuteri*), or a strain thereof. In certain embodiments, compositions disclosed herein comprise at least one *L. reuteri* strain selected from Korean Collection for Type Cultures (KCTC) deposited strains, such as KCTC 3679, KCTC 3594, KCTC 3678, and any combination thereof.

In certain embodiments, compositions disclosed herein comprise a health-associated microbe, wherein the health-associated microbe is *Staphylococcus epidermidis* (*S. epidermidis*). In certain embodiments, compositions disclosed herein comprise at least one *S. epidermidis* strain selected from 14.1.R1, AS1, AU 10, AU16, AU21, AU23, AU24, AU35, AU36, AU39, AU40, AU 44, AU48, AU53, AU60, AU73, AU81, FS1, G53, IS2, and a combination thereof.

Selected, Transformed, or Engineered Bacteria

In certain embodiments, the compositions described herein comprise one or more strains of bacteria that is selected, transformed or engineered with a gene or gene mutation that is beneficial for a skin disorder. Thus, the bacteria have been transformed into a "non-pathogenic" form, or a health-associated form from a disease-associated form. In certain embodiments, a gene that contributes to pathogenesis of a skin disorder is deleted or mutated to inactivate or reduce the corresponding gene product. In certain embodiments, a gene that reduces the pathogenesis of a skin disorder is added, or mutated to activate or increase levels of the corresponding gene product. In certain embodiments, the bacteria are grown and selected from culture or selected from healthy disease free individuals.

In certain embodiments, selected, transformed, or engineered bacteria are to be delivered as a probiotic via compositions and methods disclosed herein. In certain embodiments, selected, transformed, or engineered bacteria disclosed herein comprise a gene encoding a deoxyribose operon repressor (deoR). In certain embodiments, selected, transformed, or engineered bacteria disclosed herein express a deoxyribose operon repressor. In certain embodiments, selected, transformed, or engineered bacteria disclosed herein comprise a gene encoding a Type II lipase. In certain embodiments, selected, transformed, or engineered bacteria disclosed herein express Type II lipase. By way of non-limiting example, the Type II lipase may be a glycerol-ester hydrolase B (GehB). In certain embodiments, selected, transformed, or engineered bacteria disclosed herein do not comprise a gene encoding Type I lipase. In certain embodiments, selected, transformed, or engineered bacteria disclosed herein do not express a Type I lipase. By way of non-limiting example, the type I lipase may be a glycerol-ester hydrolase A (GehA). In certain embodiments, selected, transformed, or engineered bacteria do not comprise a pIMPLE plasmid. In certain embodiments, selected, transformed, or engineered bacteria disclosed herein comprise a gene encoding an ABC transporter. In certain embodiments, selected, transformed, or engineered bacteria express an ABC transporter. In certain embodiments, selected, transformed, or engineered bacteria disclosed herein do not comprise a gene encoding a phosphoglycerate kinase. In certain embodiments, selected, transformed, or engineered bacteria do not comprise a phosphoglycerate kinase. In certain embodiments, selected, transformed, or engineered bacteria disclosed herein do not comprise a gene encoding a DNA binding response regulator. In certain embodiments, selected, transformed, or engineered bacteria do not comprise a DNA binding response regulator.

In certain embodiments, selected, transformed, or engineered bacteria disclosed herein do not express a dermatin-sulfate adhesin (e.g., DSA1, DSA2). In certain embodiments, selected, transformed, or engineered bacteria disclosed herein do comprise a nucleic acid encoding a dermatin-sulfate adhesin (e.g., DSA1, DSA2). The absence or deletion of dermatin-sulfate adhesins may disable adhesion of microbes to keratinocytes.

In certain embodiments, selected, transformed, or engineered bacteria disclosed herein express a hyaluronidase. In some embodiments, the hyaluronidase is a hyaluronidase expressed by a Group B *Streptococcus* strain of bacteria. In certain embodiments, selected, transformed, or engineered bacteria disclosed herein do not express a hyaluronidase. In certain embodiments, selected, transformed, or engineered bacteria disclosed herein comprise a nucleic acid encoding a hyaluronidase. In some embodiments, the nucleic acid encodes a hyaluronidase expressed by a Group B *Streptococcus* strain of bacteria. In certain embodiments, selected, transformed, or engineered bacteria disclosed herein do not comprise a nucleic acid encoding a hyaluronidase. In certain embodiments, a strain of bacteria that is selected, transformed, or engineered bacteria is present or has increased expression of a hyaluronidase gene relative to the strain of bacteria when it is not selected, transformed, or engineered. In certain embodiments, a strain of bacteria that is selected, transformed, or engineered bacteria is present or has increased hyaluronidase activity relative to the strain of bacteria when it is not selected, transformed, or engineered. In certain embodiments, a strain of bacteria that is selected, transformed, or engineered bacteria is present or has reduced hyaluronidase activity relative to the strain of bacteria when it is not selected, transformed, or engineered. In certain embodiments, selected, transformed, or engineered bacteria disclosed herein lack a hyaluronidase gene.

In certain embodiments, selected, transformed, or engineered bacteria disclosed herein have reduced transposase 2 enzyme activity. In certain embodiments, selected, transformed, or engineered bacteria disclosed herein lack transposase 2 enzyme activity. In certain embodiments, a selected, transformed, or engineered strain of bacteria disclosed herein has reduced activity relative to the strain when it is not selected, transformed, or engineered, respectively.

In certain embodiments, selected, transformed, or engineered bacteria disclosed herein confer an antibiotic sensitivity to macrolide and tetracycline antibiotics. In certain embodiments, selected, transformed, or engineered bacteria disclosed herein have an absence or deletion of a thiopeptide encoding island, respectively. In certain embodiments, selected, transformed, or engineered bacteria disclosed herein have a presence or addition of a tyrosine decarboxylase island (which increases intracellular pH under stress to tolerate acidic environments), respectively. In certain embodiments, selected, transformed, or engineered bacteria disclosed herein have an ability to metabolize gelatin.

In certain embodiments, selected, transformed, or engineered bacteria comprise selected, transformed, or engineered *S. epidermis*, respectively. In certain embodiments, the selected, transformed, or engineered bacteria comprise selected, transformed, or engineered *P. acnes*.

In certain embodiments, the bacteria are transformed using recombinant DNA techniques known in the art. In certain embodiments, the bacteria are transformed by growing bacteria under selective pressure to acquire or lose a gene, gene product, or expression thereof. In a certain embodiment, the bacteria are transformed using CRISPR technology. In a certain embodiment, the bacteria are transformed using homologous recombination.

In certain embodiments, the selected, transformed, or engineered bacteria comprise a selected, transformed, or engineered *P. acnes* strain. In certain embodiments, the selected, transformed, or engineered bacteria comprise a selected, transformed, or engineered *P. acnes* strain, wherein the selected, transformed, or engineered *P. acnes* strain has a ribotype selected from RT1, RT2, RT3, RT4, RT5, RT7, RT8, RT9, and RT10. In certain embodiments, the selected, transformed, or engineered bacteria comprise a selected, transformed, or engineered *P. acnes* strain, wherein the selected, transformed, or engineered *P. acnes* strain has a ribotype selected from RT1, RT2, RT3, RT7, RT8, RT9, and RT10. In certain embodiments, the selected, transformed, or engineered bacteria comprise a selected, transformed, or engineered *P. acnes* strain, wherein the selected, transformed, or engineered *P. acnes* strain has a ribotype selected from RT1, RT2, RT3, RT7, RT8, RT9, and RT10. In certain embodiments, the selected, transformed, or engineered bacteria comprise a selected, transformed, or engineered *P. acnes* strain, wherein the selected, transformed, or engineered *P. acnes* strain has a ribotype selected from RT1, RT2, RT3, and not RT6. In certain embodiments, the selected, transformed, or engineered bacteria comprise a selected, transformed, or engineered *P. acnes* strain, wherein the selected, transformed, or engineered *P. acnes* strain has a ribotype selected from RT1 and RT2. In certain embodiments, the selected, transformed, or engineered bacteria comprise a selected, transformed, or engineered *P. acnes* strain, wherein the selected, transformed, or engineered *P. acnes* strain has a ribotype of RT1. In certain embodiments, the selected, transformed, or engineered bacteria comprise a selected, transformed, or engineered *P. acnes* strain, wherein the selected, transformed, or engineered *P. acnes* strain has a ribotype of RT2. In certain embodiments, the selected, transformed, or engineered bacteria are an RT1 strain of *P. acnes*. In certain embodiments, the selected, transformed, or engineered bacteria are an RT2 strain of *P. acnes*. In certain embodiments, the selected, transformed, or engineered bacteria are an RT3 strain of *P. acnes*. In certain embodiments, the selected, transformed, or engineered bacteria are not an RT6 strain of *P. acnes*.

Markers

Disclosed herein are compositions that comprise probiotics and health-associated microbes. Probiotics and health-associated microbes disclosed herein generally comprise at least one strain of bacteria, wherein the at least one strain of bacteria exhibits a health-associated presence, health-associated absence or health-associated expression level of at least one marker. In some instances, health-associated expression of the at least one marker is a lack of expression. In some instances, health-associated expression of the at least one marker is expression that is low as compared to expression of the at least one marker in a reference strain. In some instances, the reference strain is a pathogenic strain. In some instances, the reference strain is not a health-associated strain. In some instances, health-associated expression of the at least one marker is expression that is high as compared to expression of the at least one marker in a reference strain.

In some embodiments, the marker is a nucleic acid. In some embodiments, the nucleic acid comprises a gene encoding the marker or a portion thereof. In some embodiments, the nucleic acid is a gene encoding the marker or a portion thereof. In some embodiments, the marker is a protein. In some embodiments, the marker is a peptide (e.g., less than or equal to 100 amino acids). In some embodiments, the marker is not a nucleic acid or a protein. Non-limiting examples of a marker that neither comprises a nucleic acid or protein include glycans and lipids.

Exemplary markers of health-associated microbes disclosed herein include, but are not limited to, a deoxyribose operon repressor, a CRISPR associated protein (Cas), a lipase, an ATP binding cassette transporter, a DNA binding response regulator, a phosphoglycerate kinase, dermatin-sulfate adhesin, and hyaluronidase. In some instances, the at least one strain of bacteria comprises a plasmid. In some instances, presence or absence of the plasmid is a marker. By way of non-limiting example, the plasmid may be a pIMPLE plasmid disclosed herein. As further described herein, presence of a deoR, a type II lipase, an ABC transporter, or a Cas5, or a combination thereof, is generally associated with probiotics and health-associated microbes disclosed herein. In contrast, probiotics and health-associated microbes disclosed herein are generally associated with an absence or low expression of a pIMPLE plasmid, a type I lipase, a DNA binding response regulator, a phosphoglycerate kinase, or dermatin-sulfate adhesin, or a combination thereof. However, it would be understood to one of skill in the art that nature presents exceptions to such generalities. Therefore, expression patterns of these markers that are alternative or contrary to those described herein are contemplated as well. Compositions comprising one or more strains characterized by such markers are further characterized herein, including the description as follows.

deoR

In some embodiments, the marker is a deoxyribose operon repressor (deoR) protein. In some embodiments, the marker is a nucleic acid encoding a deoxyribose operon repressor (deoR). In some embodiments, the deoR is a deoR family transcriptional regulator expressed in *Propionibacterium acnes* subsp. *defendens* (ATCC 11828, GenBank: AER05724.1). In certain embodiments, the at least one strain of bacteria has been selected, transformed, or engineered to acquire the presence of the deoR. In certain embodiments, the deoR has a sequence that is at least 80% homologous to SEQ ID NO: 1. In certain embodiments, the deoR has a sequence that is at least 90% homologous to SEQ ID NO: 1. In certain embodiments, the deoR has a sequence that is at least 95% homologous to SEQ ID NO: 1. In certain embodiments, the deoR has a sequence that is at least 97% homologous to SEQ ID NO: 1. In certain embodiments, the deoR has a sequence that is at least 98% homologous to SEQ ID NO: 1. In certain embodiments, the deoR has a sequence that is at least 99% homologous to SEQ ID NO: 1. In certain embodiments, the deoR has a sequence that is 100% homologous to SEQ ID NO: 1. In certain embodiments, the at least one strain of bacteria has greater expression or activity of a deoxyribose operon repressor than a reference strain (e.g., pathogenic strain, not a health-associated strain). In certain embodiments, the at least one strain has at least about 1.5-fold, at least about 2-fold, at least about 3-fold, at least about 5-fold or at least about 10-fold greater expression or activity of the deoxyribose operon repressor as compared to the reference strain.

pIMPLE Plasmid

In some embodiments, the marker is a pIMPLE plasmid. In some embodiments, the marker is an absence of a pIMPLE plasmid. In some embodiments, the marker is a low percentage of a pIMPLE plasmid (e.g., <10%). In some embodiments, compositions disclosed herein comprise at least one strain of bacteria, wherein the at least one strain of bacteria does not comprise a pIMPLE plasmid. In certain embodiments, the pIMPLE plasmid has a sequence that is at least about 80% homologous to SEQ ID NO: 2. In certain embodiments, the pIMPLE plasmid has a sequence that is at least about 90% homologous to SEQ ID NO: 2. In certain embodiments, the pIMPLE plasmid has a sequence that is at least about 95% homologous to SEQ ID NO: 2. In certain embodiments, the pIMPLE plasmid has a sequence that is at least about 97% homologous to SEQ ID NO: 2. In certain embodiments, the pIMPLE plasmid has a sequence that is at least about 98% homologous to SEQ ID NO: 2. In certain embodiments, the pIMPLE plasmid has a sequence that is at least about 99% homologous to SEQ ID NO: 2. In certain embodiments, the pIMPLE plasmid has a sequence that is 100% homologous to SEQ ID NO: 2. In certain embodiments, a plasmid with at least 80%, 90%, 95%, 98%, 99%, or 100% homology to SEQ ID NO: 2 is partially or completely deleted from the at least one strain of bacteria. In certain embodiments, a plasmid with at least 80%, 90%, 95%, 98%, 99%, or 100% homology to SEQ ID NO: 2 is disrupted by an insertion of one or more nucleotides or a introduction of a frameshift mutation in the a selected, transformed, or engineered strain of bacteria. In certain embodiments, the at least one strain of bacteria contains portions of a complete pIMPLE plasmid (SEQ ID NO: 2). In certain embodiments, the at least one strain of bacteria may comprise less than about 25%, 20%, 15%, 14%, 13%, 12%, 11%, 10%, 9%, 8%, 7%, 6% of the complete pIMPLE sequence set forth in SEQ ID NO: 2. In certain embodiments, the at least one strain of bacteria does not comprise a specific portion of the pIMPLE plasmid that is present in an RT6 strain or any other disease associated strain. In certain embodiments, the at least one strain of bacteria comprises a low copy number of a pIMPLE plasmid (SEQ ID NO: 2). In certain embodiments, the at least one strain of bacteria comprises less than 5 copies of pIMPLE plasmid per bacterial genome. In certain embodiments, the at least one strain of bacteria comprises less than 4 copies of pIMPLE plasmid per bacterial genome. In certain embodiments, the at least one strain of bacteria comprises less than 3 copies of pIMPLE plasmid per bacterial genome. In certain embodiments, the at least one strain of bacteria comprises less than 2 copies of pIMPLE plasmid per bacterial genome. In certain embodiments, the at least one strain of bacteria comprises 1 copy of pIMPLE plasmid per bacterial genome. In certain embodiments, the at least one strain of bacteria comprises a low percentage of pIMPLE plasmid (SEQ ID NO: 2). In certain embodiments, the bacteria comprise less than about 15%, 14%, 13%, 12%, 11%, 10%, 9%, 8%, 7%, 6%, 5%, 4%, 3%, 2%, 1% pIMPLE plasmid. In certain embodiments, the at least one strain of bacteria comprises less than about 1.0%, 0.9%, 0.8%, 0.7%, 0.6%, 0.5%, 0.4%, 0.3%, 0.2%, 0.1% pIMPLE plasmid. pIMPLE plasmid percentage can be determined by next-generation sequencing of *P. acnes* bacteria, as % reads aligned. In certain embodiments, the pIMPLE percentage is percentage of total sequencing reads that align to pIMPLE from HL096PA1 (an RT5).

Lipases

In some embodiments, the marker is a lipase. In some embodiments, the marker is a nucleic acid encoding a lipase. In some embodiments, the marker is an absence of a nucleic acid encoding a lipase. In some embodiments, compositions disclosed herein comprise a strain of bacteria that expresses a lipase. In some embodiments, the lipase is Type I lipase. In some embodiments, the lipase is Type II lipase. In some embodiments, the compositions disclosed herein comprise a strain of bacteria that does not express a lipase. In some embodiments, the compositions disclosed herein comprise a strain of bacteria that does not express a Type I lipase. In some embodiments, the compositions disclosed herein comprise a strain of bacteria that does not express a Type II lipase. In some embodiments, the strain of bacteria comprises a nucleic acid encoding a Type II lipase. Type I lipase and Type II lipase, as described herein, may be encoded by a similar nucleic acid. For example, a gene encoding Type I lipase will encode a Type II lipase upon a 6 bp deletion in the intergenic region and a single base deletion, the latter causing a frameshift that creates premature STOP codon, see, e.g., FIG. 7.

Type I Lipase

In some embodiments, the marker is a Type I lipase. In some embodiments, compositions disclosed herein comprise at least one strain of bacteria, wherein the at least one strain of bacteria does not express a Type I lipase. In some embodiments, compositions disclosed herein comprise at least one strain of bacteria, wherein the at least one strain of bacteria does not comprise a nucleic acid encoding a Type I lipase. In certain embodiments, compositions disclosed herein comprise at least one strain of bacteria, wherein the at least one strain of bacteria has been selected, transformed, or engineered for an absence of Type I lipase expression or activity. In certain embodiments, compositions disclosed herein comprise at least one strain of bacteria, wherein the at least one strain of bacteria has been selected, transformed, or engineered for the presence of Type I lipase expression or activity. In certain embodiments, compositions disclosed herein comprise at least one strain of bacteria, wherein the strain has been selected, transformed, or engineered for lower expression or activity of Type I lipase relative to a reference strain (e.g., pathogenic strain, not a health-associated strain). In certain embodiments, at least one strain of bacteria has at least about 1.5-fold lower expression or activity of Type I lipase compared to the reference strain. In certain embodiments, at least one strain of bacteria has at least about 2-fold lower expression or activity of Type I lipase compared to the reference strain. In certain embodiments, at least one strain of bacteria has at least about 3-fold lower expression or activity of Type I lipase compared to the reference strain. In certain embodiments, at least one strain of bacteria has at least about 5-fold lower expression or activity of Type I lipase compared to the reference strain. In certain embodiments, at least one strain of bacteria has at least about 10-fold lower expression or activity of Type I lipase compared to the reference strain.

In some embodiments, compositions disclosed herein comprise at least one strain of bacteria, wherein the at least one strain of bacteria expresses a Type I lipase. In certain embodiments, compositions disclosed herein comprise at least one strain of bacteria, wherein the at least one strain of bacteria has been selected, transformed, or engineered for the presence of Type I lipase expression or activity. In certain embodiments, compositions disclosed herein comprise at least one strain of bacteria, wherein the strain has been selected, transformed, or engineered for greater expression or activity of Type I lipase relative to the reference strain.

In some embodiments, at least a portion of the Type I lipase is encoded by a sequence of SEQ ID NO: 10. In some embodiments, at least a portion of the Type I lipase is encoded by a sequence that is at least 80% homology to SEQ ID NO: 10. In some embodiments, at least a portion of the Type I lipase is encoded by a sequence that is at least 90% homology to SEQ ID NO: 10. In some embodiments, at least a portion of the Type I lipase is encoded by a sequence that is at least 95% homology to SEQ ID NO: 10. In some embodiments, at least a portion of the Type I lipase is encoded by a sequence that is at least 97% homology to SEQ ID NO: 10. In some embodiments, at least a portion of the Type I lipase is encoded by a sequence that is at least 98% homology to SEQ ID NO: 10. In some embodiments, at least a portion of the Type I lipase is encoded by a sequence that is at least 99% homology to SEQ ID NO: 10. In some embodiments, at least a portion of the Type I lipase is encoded by a sequence that is at least 80% homology to SEQ ID NO: 10. In some embodiments, at least a portion of the Type I lipase is encoded by a sequence of SEQ ID NO: 60. In some embodiments, at least a portion of the Type I lipase is encoded by a sequence that is at least 80% homology to SEQ ID NO: 60. In some embodiments, at least a portion of the Type I lipase is encoded by a sequence that is at least 90% homology to SEQ ID NO: 60. In some embodiments, at least a portion of the Type I lipase is encoded by a sequence that is at least 95% homology to SEQ ID NO: 60. In some embodiments, at least a portion of the Type I lipase is encoded by a sequence that is at least 97% homology to SEQ ID NO: 60. In some embodiments, at least a portion of the Type I lipase is encoded by a sequence that is at least 98% homology to SEQ ID NO: 60. In some embodiments, at least a portion of the Type I lipase is encoded by a sequence that is at least 99% homology to SEQ ID NO: 60.

In some embodiments, at least a portion of the Type I lipase is encoded by a sequence that is at least 80% homology to SEQ ID NO: 60.

In certain embodiments, a nucleic acid with at least 80%, 90%, 95%, 98%, 99%, or 100% homology to SEQ ID NO: 10 is partially or completely deleted from the at least one strain. In certain embodiments, the nucleic acid is deleted by at least about 5%, at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95% or more from the 3 prime end of the nucleic acid. In certain embodiments, the nucleic acid is deleted by at least about 5%, at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95% or more from the 5 prime end of the nucleic acid.

In certain embodiments, a nucleic acid with at least 80%, 90%, 95%, 98%, 99%, or 100% homology to SEQ ID NO: 10 is disrupted by an insertion of one or more nucleotides or a introduction of a frameshift mutation in the at least one strain. In certain embodiments, at least about 5%, at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, or at least about 95% of the nucleic acid with at least 80%, 90%, 95%, 98%, 99%, or 100% homology to SEQ ID NO: 10 is disrupted.

Type II Lipase

In some embodiments, compositions disclosed herein comprise at least one strain of bacteria, wherein the at least one strain of bacteria expresses a Type II lipase. A non-limiting example of a Type II lipase is Lipase ADE00051, HMPREF0675_4856. In some embodiments, compositions disclosed herein comprise at least one strain of bacteria, wherein the at least one strain of bacteria comprises a nucleic acid encoding a Type II lipase. In certain embodiments, the at least one strain of bacteria has been selected, transformed, or engineered to express a Type II lipase. In certain embodiments, the at least one strain of bacteria has at least about 1.5-fold greater expression or activity of Type II lipase compared to a reference strain (e.g., pathogenic strain, not a health-associated strain). In certain embodiments, the at least one strain of bacteria has at least about 2-fold greater expression or activity of Type II lipase compared to the reference strain. In certain embodiments, the at least one strain of bacteria has at least about 3-fold greater expression or activity of Type II lipase compared to the reference strain. In certain embodiments, the at least one strain of bacteria has at least about 5-fold greater expression or activity of Type II lipase compared to the reference strain. In certain embodiments, the at least one strain of bacteria has at least about 10-fold greater expression or activity of Type II lipase compared to the reference strain.

Figure 7:
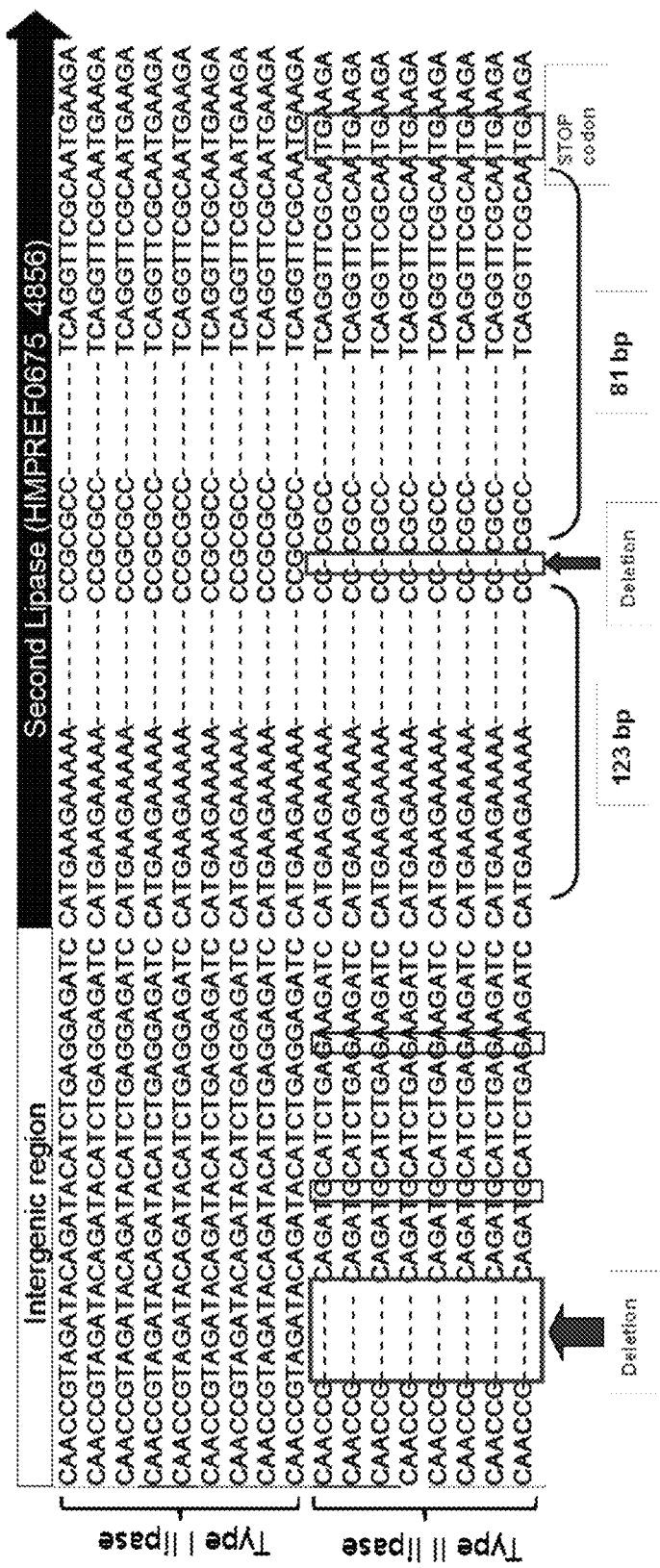
FIG. 7 shows mutations in a gene encoding a *P. acnes* type I lipase that result in a gene encoding a *P. acnes* type II lipase. Type I lipase Intergenic Region corresponds to SEQ ID NO.: 44. Type I lipase Second Lipase (region) (HMPREF0675_4856) corresponds to SEQ ID NOS: 45, 46 and 47, respectively, in order of appearance. Type II lipase Second Lipase (region) (HMPREF0675_4856) corresponds to SEQ ID NOS: 50, 55 and 56, respectively, in order of appearance. Type I lipase Intergenic Region corresponds to SEQ ID NO.: 44. Type II lipase Intergenic Region corresponds to SEQ ID NO.: 49. SEQ ID NO: 57 is disclosed as the sequence extending from the Type I lipase Intergenic Region through the next 12 residues in the Type I lipase Second Lipase (region). SEQ ID NO: 58 is disclosed as the sequence extending from the Type II lipase Intergenic Region through the next 12 residues in the Type II lipase Second Lipase (region).

In some embodiments, at least a portion of the type II lipase is expressed from a nucleic acid comprising SEQ ID NO.: 61. SEQ ID NO.: 61 is found in the complete circular genome of Propionibacterium acnes ATCC 11828 and starts at position 390,423 of ATCC 11828. The following subsequent positions are in reference to the first nucleotide of SEQ ID NO.: 61. The lipase coding sequence is bases 22-1032, referred to herein as ADE0051, HMPREF0675_4856, and SEQ ID NO.: 3. Bases 1-21 is an intergenic region. Type II Lipase has a Gin position 7 and an A in position 16. In some embodiments, at least a portion of the type I lipase is expressed from a nucleic acid comprising SEQ ID NO.: 60. In contrast, relative to SEQ ID NO. 61, SEQ ID NO. 60 has a 6 bp sequence TAGATA inserted between base pairs 1 and 2, an A in position 7, a G in position 16, and a G between base pairs 145 and 146. SEQ ID NO.: 60 and SEQ ID NO.: 61 are shown in Table 8. FIG. 7 also illustrates the differences between sequences encoding Type I lipase and Type II lipase.

In certain embodiments, at least a portion of the Type II lipase is encoded by a nucleic acid with at least about 90% homology to SEQ ID NO: 3. In certain embodiments, at least a portion of the Type II lipase is encoded by a nucleic acid with at least about 95% homology to SEQ ID NO: 3. In certain embodiments, at least a portion of the Type II lipase is encoded by a nucleic acid with at least about 97% homology to SEQ ID NO: 3. In certain embodiments, at least a portion of the Type II lipase is encoded by a nucleic acid with at least about 97% homology to SEQ ID NO: 3. In certain embodiments, at least a portion of the Type II lipase is encoded by a nucleic acid with at least about 99% homology to SEQ ID NO: 3. In certain embodiments, at least a portion of the Type II lipase is encoded by a nucleic acid with 100% homology to SEQ ID NO: 3. In certain embodiments, at least a portion of the Type II lipase is encoded by a nucleic acid with at least about 90% homology to SEQ ID NO: 61. In certain embodiments, at least a portion of the Type II lipase is encoded by a nucleic acid with at least about 95% homology to SEQ ID NO: 61. In certain embodiments, at least a portion of the Type II lipase is encoded by a nucleic acid with at least about 97% homology to SEQ ID NO: 61. In certain embodiments, at least a portion of the Type II lipase is encoded by a nucleic acid with at least about 97% homology to SEQ ID NO: 61. In certain embodiments, at least a portion of the Type II lipase is encoded by a nucleic acid with at least about 99% homology to SEQ ID NO: 61. In certain embodiments, at least a portion of the Type II lipase is encoded by a nucleic acid with 100% homology to SEQ ID NO: 61.

CRISPR/Cas5

In some embodiments, compositions disclosed herein comprise at least one strain of bacteria, wherein the at least one strain of bacteria comprises a CRISPR locus or a portion of a CRISPR locus. In some embodiments, compositions disclosed herein comprise at least one strain of bacteria, wherein the at least one strain of bacteria expresses a CRISPR-associated protein (Cas). By way of non-limiting example, the CRISPR-associated proteins include Cas5, Cas9, Cpf1, Cas3, Cas8a, Cas8b, Cas8c, Cas10d, Cse1, Cse2, Csy1, Csy2, Csy3, GSU0054, Cas10, Csm2, Cmr5, Cas10, Csx11, Csx10, Csf1, Csn2, Cas4, C2c1, C2c3, and C2c2.

In some embodiments, compositions disclosed herein comprise at least one strain of bacteria, wherein the at least one strain of bacteria expresses a Cas5. In some embodiments, compositions disclosed herein comprise at least one strain of bacteria, wherein the at least one strain of bacteria comprises a nucleic acid encoding a Cas5. In certain embodiments, the at least one strain of bacteria has been selected, transformed, or engineered to express a Cas5. In certain embodiments, the at least one strain of bacteria has at least about 1.5-fold greater expression or activity of Cas5 compared to a reference strain (e.g., pathogenic strain, not a health-associated strain). In certain embodiments, the at least one strain of bacteria has at least about 2-fold greater expression or activity of Cas5 compared to the reference strain. In certain embodiments, the at least one strain of bacteria has at least about 3-fold greater expression or activity of Cas5 compared to the reference strain. In certain embodiments, the at least one strain of bacteria has at least about 5-fold greater expression or activity of Cas5 compared to the reference strain. In certain embodiments, the at least one strain of bacteria has at least about 10-fold greater expression or activity of Cas5 compared to the reference strain.

In some instances, the at least one strain of bacteria expresses Cas5. In some embodiments, a strain of *P. acnes* is characterized as a health-associated *P. acnes* or a disease-associated *P. acnes* based on the presence of Cas5. In some embodiments, Cas5 is found in *P. acnes* strain ATCC 11828. In some embodiments, Cas5 is encoded by a sequence as set forth in SEQ ID NO: 8. In some embodiments, Cas5 is encoded by a sequence that is at least about 70%, 80%, 85%, 90%, 91%, 92%, 93%, 94%, 95%, 96%, 97%, 98%, 99%, or 100% homologous to SEQ ID NO: 8. In some embodiments, Cas5 is encoded by a sequence that is about 70%, 80%, 85%, 90%, 91%, 92%, 93%, 94%, 95%, 96%, 97%, 98%, 99%, or 100% sequence identity to SEQ ID NO: 8. In some embodiments, Cas5 is encoded by a sequence that is about 95% homologous to SEQ ID NO: 8. In some embodiments, Cas5 is encoded by a sequence that is about 97% homologous to SEQ ID NO: 8. In some embodiments, Cas5 is encoded by a sequence that is about 99% homologous to SEQ ID NO: 8. In some embodiments, Cas5 is encoded by a sequence that is about 100% homologous to SEQ ID NO: 8.

In some instances, the at least one strain of bacteria comprises a nucleic acid encoding Cas5, wherein the nucleic acid comprises at least about 10, at least about 20, at least about 30, at least about 40, at least about 50, at least about 60, at least about 70, at least about 80, at least about 90, at least about 100, at least about 110, at least about 120, at least about 130, at least about 140, at least about 150, at least about 160, at least about 170, at least about 180, at least about 190, at least about 200, at least about 210, at least about 220, at least about 230, at least about 240, at least about 250, at least about 260, at least about 270, at least about 280, at least about 290, at least about 300, at least about 310, at least about 320, at least about 330, at least about 340, at least about 350, at least about 360, at least about 370, at least about 380, at least about 390, at least about 400, at least about 410, at least about 420, at least about 430, at least about 440, at least about 450, at least about 460, at least about 470, at least about 480, at least about 490, at least about 500, at least about 550, at least about 650, at least about 700, or more than about 700 consecutive bases of SEQ ID NO: 8. In some instances, the at least one strain of bacteria comprises a nucleic acid encoding Cas5, wherein the nucleic acid comprises about 10, about 20, about 30, about 40, about 50, about 60, about 70, about 80, about 90, about 100, about 110, about 120, about 130, about 140, about 150, about 160 about 170, about 180, about 190, about 200, about 210, about 220, about 230, about 240, about 250, about 260, about 270, about 280, about 290, about 300, about 310, about 320, about 330, about 340, about 350, about 360, about 370, about 380, about 390, about 400, about 410, about 420, about 430, about 440, about 450, about 460, about 470, about 480, about 490, about 500, about 550, about 650, about 700, or more than about 700 consecutive bases of SEQ ID NO: 8.

ABC Transporter

In some embodiments, compositions disclosed herein comprise at least one strain of bacteria, wherein the at least one strain of bacteria comprises an ATP-binding cassette transporter. In certain embodiments, the at least one strain of bacteria comprises a nucleic acid encoding an ATP-binding cassette transporter (ABC transporter). In certain embodiments, the at least one strain of bacteria is selected for expression or overexpression of a nucleic acid encoding an ABC transporter. In certain embodiments, the at least one strain of bacteria is selected for increased activity of an ABC transporter. In certain embodiments, the at least one strain of bacteria is selected for the presence of a nucleic acid encoding an ABC transporter. In certain embodiments, the at least one strain of bacteria is transformed for overexpression of a nucleic acid encoding an ABC transporter. In certain embodiments, the at least one strain of bacteria is transformed for increased activity of an ABC transporter. In certain embodiments, the at least one strain of bacteria is transformed for the presence of a nucleic acid encoding an ABC transporter. In certain embodiments, the at least one strain of bacteria is engineered for overexpression of a nucleic acid encoding an ABC transporter. In certain embodiments, the at least one strain of bacteria is engineered for increased activity of an ABC transporter. In certain embodiments, the at least one strain of bacteria is engineered for the presence of a nucleic acid encoding an ABC transporter. In some embodiments, the ABC transporter is a portion of a known ABC transporter. In some embodiments, the ABC transporter is a portion of a known ABC transporter, wherein the portion of the known ABC transporter can perform an activity of the known ABC transporter. In some embodiments, the ABC transporter is a portion of a known ABC transporter, wherein the portion of the known ABC transporter can perform an enzymatic activity of the known ABC transporter. In some embodiments, the ABC transporter is a portion of a known ABC transporter, wherein the portion of the known ABC transporter can perform a transport activity of the known ABC transporter.

In certain embodiments, the at least one strain has at least about 1.5-fold greater expression or activity of ABC transporter compared to a reference strain (e.g., pathogenic strain, not a health-associated strain). In certain embodiments, the at least one strain has at least about 2-fold greater expression or activity of ABC transporter compared to the reference strain. In certain embodiments, the at least one strain has at least about 3-fold greater expression or activity of ABC transporter compared to the reference strain. In certain embodiments, the at least one strain has at least about 5-fold greater expression or activity of ABC transporter compared to the reference strain. In certain embodiments, the at least one strain has at least about 10-fold greater expression or activity of ABC transporter compared to the reference strain.

In some embodiments, ABC transporters disclosed herein are encoded by a sequence of SEQ ID NO.: 6 or a sequence that is homologous to SEQ ID NO.: 6. In some embodiments, the ABC transporter is encoded by a sequence that is at least about 80% homologous to SEQ ID NO: 6. In some embodiments, the ABC transporter is encoded by a sequence that is at least about 90% homologous to SEQ ID NO: 6. In some embodiments, the ABC transporter is encoded by a sequence that is at least about 95% homologous to SEQ ID NO: 6. In some embodiments, the ABC transporter is encoded by a sequence that is at least about 96% homologous to SEQ ID NO: 6. In some embodiments, the ABC transporter is encoded by a sequence that is at least about 97% homologous to SEQ ID NO: 6. In some embodiments, the ABC transporter is encoded by a sequence that is at least about 98% homologous to SEQ ID NO: 6. In some embodiments, the ABC transporter is encoded by a sequence that is at least about 99% homologous to SEQ ID NO: 6. In some embodiments, the ABC transporter is encoded by a sequence that is 100% homologous to SEQ ID NO: 6. In certain embodiments, the at least one strain is (completely or partially) selected, transformed, or engineered with a nucleic acid that is at least about 80%, 90%, 95%, 98%, 99%, or 100% homology to SEQ ID NO: 6 is partially or completely present in the at least one strain.

DNA Binding Response Regulator

In some embodiments, compositions disclosed herein comprise at least one strain of bacteria, wherein the at least one strain of bacteria does not comprise a DNA binding response regulator. In certain embodiments, the at least one strain does not comprise a nucleic acid encoding a DNA binding response regulator. In certain embodiments, the at least one strain has been selected for reduced expression or activity of a DNA binding response regulator. In certain embodiments, the at least one strain has been selected for an absence of a DNA binding response regulator. In certain embodiments, bacteria disclosed herein have been transformed for reduced expression or activity of a DNA binding response regulator. In certain embodiments, bacteria disclosed herein have been transformed for an absence of a DNA binding response regulator. In certain embodiments, bacteria disclosed herein have been engineered for reduced expression or activity of a DNA binding response regulator. In certain embodiments, bacteria disclosed herein have been engineered for an absence of a DNA binding response regulator.

In certain embodiments, the at least one strain of bacteria has at least about 1.5-fold less expression or activity of a DNA binding response regulator relative to a reference strain (e.g., pathogenic strain, not a health-associated strain). In certain embodiments, the at least one strain has at least about 2-fold less expression or activity of a DNA binding response regulator relative to the reference strain. In certain embodiments, the at least one strain has at least about 3-fold less expression or activity of a DNA binding response regulator relative to the reference strain. In certain embodiments, the at least one strain has at least about 5-fold less expression or activity of a DNA binding response regulator relative to the reference strain. In certain embodiments, the at least one strain has at least about 10-fold less expression or activity of a DNA binding response regulator relative to the reference strain.

In certain embodiments, the at least one strain has been selected, transformed, or engineered to remove a nucleic acid with at least 90% homology to SEQ ID NO: 7. In certain embodiments, the at least one strain has been selected, transformed, or engineered to express a nucleic acid with at least 90% homology to SEQ ID NO: 7 at a lower level relative to the reference strain. In certain embodiments, the at least one strain has been selected, transformed, or engineered to remove a nucleic acid with at least 95% homology to SEQ ID NO: 7. In certain embodiments, the at least one strain has been selected, transformed, or engineered to express a nucleic acid with at least 95% homology to SEQ ID NO: 7 at a lower level relative to the reference strain. In certain embodiments, the at least one strain has been selected, transformed, or engineered to remove a nucleic acid with at least 97% homology to SEQ ID NO: 7. In certain embodiments, the at least one strain has been selected, transformed, or engineered to express a nucleic acid with at least 97% homology to SEQ ID NO: 7 at a lower level relative to the reference strain. In certain embodiments, the at least one strain has been selected, transformed, or engineered to remove a nucleic acid with at least 99% homology to SEQ ID NO: 7. In certain embodiments, the at least one strain has been selected, transformed, or engineered to express a nucleic acid with at least 99% homology to SEQ ID NO: 7 at a lower level relative to the reference strain. In certain embodiments, the at least one strain has been selected, transformed, or engineered to remove a nucleic acid with 100% homology to SEQ ID NO: 7. In certain embodiments, the at least one strain has been selected, transformed, or engineered to express a nucleic acid with 100% homology to SEQ ID NO: 7 at a lower level relative to the reference strain.

In certain embodiments, the at least one strain comprises a nucleic acid that is disrupted by an insertion of one or more nucleotides or a introduction of a frameshift mutation, wherein the nucleic acid has 80%, 90%, 95%, 98%, 99%, or 100% homology to SEQ ID NO: 7, before being disrupted. For example, in certain embodiments, a nucleic acid with at least 80%, 90%, 95%, 98%, 99%, or 100% homology to SEQ ID NO: 7 is deleted by at least about 5%, at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95% or more from the 3 prime end of the nucleic acid. In certain embodiments, the nucleic acid with at least 80%, 90%, 95%, 98%, 99%, or 100% homology to SEQ ID NO: 7 is deleted by at least about 5%, at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95% or more from the 5 prime end of the nucleic acid.

Phosphoglycerate Kinase

In some embodiments, compositions disclosed herein comprise at least one strain of bacteria, wherein the at least one strain of bacteria does not comprise a phosphoglycerate kinase. In certain embodiments, the at least one strain does not comprise a nucleic acid encoding a phosphoglycerate kinase. In certain embodiments, the at least one strain has been selected for reduced expression or activity of a phosphoglycerate kinase. In certain embodiments, the at least one strain has been selected for an absence of a phosphoglycerate kinase. In certain embodiments, bacteria disclosed herein have been transformed for reduced expression or activity of a phosphoglycerate kinase. In certain embodiments, bacteria disclosed herein have been transformed for an absence of a phosphoglycerate kinase. In certain embodiments, bacteria disclosed herein have been engineered for reduced expression or activity of a phosphoglycerate kinase. In certain embodiments, bacteria disclosed herein have been engineered for an absence of a phosphoglycerate kinase.

In certain embodiments, the at least one strain of bacteria has at least about 1.5-fold less expression or activity of a phosphoglycerate kinase relative to a reference strain (e.g., pathogenic strain, not a health-associated strain). In certain embodiments, the at least one strain has at least about 2-fold less expression or activity of a phosphoglycerate kinase relative to the reference strain. In certain embodiments, the at least one strain has at least about 3-fold less expression or activity of a phosphoglycerate kinase relative to the reference strain. In certain embodiments, the at least one strain has at least about 5-fold less expression or activity of a phosphoglycerate kinase relative to the reference strain. In certain embodiments, the at least one strain has at least about 10-fold less expression or activity of a phosphoglycerate kinase relative to the reference strain.

In certain embodiments, the at least one strain has been selected, transformed, or engineered to remove a nucleic acid with at least 90% homology to SEQ ID NO: 9. In certain embodiments, the at least one strain has been selected, transformed, or engineered to express a nucleic acid with at least 90% homology to SEQ ID NO: 9 at a lower level relative to the reference strain. In certain embodiments, the at least one strain has been selected, transformed, or engineered to remove a nucleic acid with at least 95% homology to SEQ ID NO: 9. In certain embodiments, the at least one strain has been selected, transformed, or engineered to express a nucleic acid with at least 95% homology to SEQ ID NO: 9 at a lower level relative to the reference strain. In certain embodiments, the at least one strain has been selected, transformed, or engineered to remove a nucleic acid with at least 97% homology to SEQ ID NO: 9. In certain embodiments, the at least one strain has been selected, transformed, or engineered to express a nucleic acid with at least 97% homology to SEQ ID NO: 9 at a lower level relative to the reference strain. In certain embodiments, the at least one strain has been selected, transformed, or engineered to remove a nucleic acid with at least 99% homology to SEQ ID NO: 9. In certain embodiments, the at least one strain has been selected, transformed, or engineered to express a nucleic acid with at least 99% homology to SEQ ID NO: 9 at a lower level relative to the reference strain. In certain embodiments, the at least one strain has been selected, transformed, or engineered to remove a nucleic acid with 100% homology to SEQ ID NO: 9. In certain embodiments, the at least one strain has been selected, transformed, or engineered to express a nucleic acid with 100% homology to SEQ ID NO: 9 at a lower level relative to the reference strain.

In certain embodiments, the at least one strain comprises a nucleic acid that is disrupted by an insertion of one or more nucleotides or a introduction of a frameshift mutation, wherein the nucleic acid has 80%, 90%, 95%, 98%, 99%, or 100% homology to SEQ ID NO: 9, before being disrupted. For example, in certain embodiments, a nucleic acid with at least 80%, 90%, 95%, 98%, 99%, or 100% homology to SEQ ID NO: 9 is deleted by at least about 5%, at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95% or more from the 3 prime end of the nucleic acid. In certain embodiments, the nucleic acid with at least 80%, 90%, 95%, 98%, 99%, or 100% homology to SEQ ID NO: 9 is deleted by at least about 5%, at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95% or more from the 5 prime end of the nucleic acid.

Dermatin-Sulfate Adhesin

In some embodiments, compositions disclosed herein comprise at least one strain of bacteria, wherein the at least one strain of bacteria does not comprise a dermatin-sulfate adhesin (DSA1 and DSA2). In certain embodiments, the at least one strain does not comprise a nucleic acid encoding a dermatin-sulfate adhesin. In certain embodiments, the at least one strain has been selected for reduced expression or activity of a dermatin-sulfate adhesin. In certain embodiments, the at least one strain has been selected for an absence of a dermatin-sulfate adhesin. In certain embodiments, bacteria disclosed herein have been transformed for reduced expression or activity of a dermatin-sulfate adhesin. In certain embodiments, bacteria disclosed herein have been transformed for an absence of a dermatin-sulfate adhesin. In certain embodiments, bacteria disclosed herein have been engineered for reduced expression or activity of a dermatin-sulfate adhesin. In certain embodiments, bacteria disclosed herein have been engineered for an absence of a dermatin-sulfate adhesin.

In certain embodiments, the bacteria have been selected, transformed, or engineered for lower expression or activity or deletion of a dermatin-sulfate adhesin. In certain embodiments, the selected, transformed, or engineered bacteria has 1.5-fold, 2-fold, 3-fold, or 10-fold less expression or activity of the DSA 1 or DSA 2 compared to a reference strain. In certain embodiments, DSA1 or DSA2 is partially or completely deleted from the genome of the selected, transformed, or engineered, or engineered bacteria. In certain embodiments, DSA1 or DSA2 is disrupted by an insertion of one or more nucleotides or an introduction of a frameshift mutation in the genome of the selected, transformed, or engineered, or engineered bacteria.

Hyaluronidase

In some embodiments, compositions disclosed herein comprise at least one strain of bacteria, wherein the at least one strain of bacteria does not comprise a hyaluronidase. Hyaluronidase is also known as hyaluronate lyase (locus tag PPA_RS01930). In some embodiments, compositions disclosed herein comprise at least one strain of bacteria, wherein the at least one strain of bacteria does not have hyaluronidase activity. In some embodiments, compositions disclosed herein comprise at least one strain of bacteria, wherein the at least one strain of bacteria does not comprise a nucleic acid encoding a hyaluronidase. In certain embodiments, the bacteria have been selected, transformed, or engineered for lower expression or activity of hyaluronidase relative to the bacteria before selecting, transforming or engineering, respectively.

In some embodiments, compositions disclosed herein comprise at least one strain of bacteria, wherein the at least one strain of bacteria comprises a hyaluronidase. In some embodiments, compositions disclosed herein comprise at least one strain of bacteria, wherein the at least one strain of bacteria has hyaluronidase activity. In some embodiments, compositions disclosed herein comprise at least one strain of bacteria, wherein the at least one strain of bacteria has a nucleic acid encoding a hyaluronidase. In certain embodiments, the bacteria have been selected, transformed, or engineered for greater expression or activity of hyaluronidase relative to the bacteria before selecting, transforming or engineering, respectively.

In certain embodiments, the selected, transformed, or engineered bacteria have 1.5-fold greater or lower expression or activity of hyaluronate lyase compared to a non-selected, transformed, or engineered strain. In certain embodiments, the selected, transformed, or engineered bacteria have 2-fold greater or lower expression or activity of hyaluronate lyase compared to a non-selected, transformed, or engineered strain. In certain embodiments, the selected, transformed, or engineered bacteria have 3-fold greater or lower expression or activity of hyaluronate lyase compared to a non-selected, transformed, or engineered strain. In certain embodiments, the selected, transformed, or engineered bacteria have 5-fold greater or lower expression or activity of hyaluronate lyase compared to a non-selected, transformed, or engineered strain. In certain embodiments, the selected, transformed, or engineered bacteria have 10-fold greater or lower expression or activity of hyaluronate lyase compared to a non-selected, transformed, or engineered strain. In certain embodiments, the bacteria have been selected, transformed, or engineered to acquire or express at a greater level, a nucleic acid with at least 90% homology to SEQ ID NO: 4. In certain embodiments, the bacteria have been selected, transformed, or engineered to acquire or express at a greater level, a nucleic acid with at least 95% homology to SEQ ID NO: 4. In certain embodiments, the bacteria have been selected, transformed, or engineered to acquire or express at a greater level, a nucleic acid with at least 97% homology to SEQ ID NO: 4. In certain embodiments, the bacteria have been selected, transformed, or engineered to acquire or express at higher level, a nucleic acid with at least 97% homology to SEQ ID NO: 4. In certain embodiments, the bacteria have been selected, transformed, or engineered to acquire or express at a higher level, a nucleic acid with at least 99% homology to SEQ ID NO: 4. In certain embodiments, the bacteria have been selected, transformed, or engineered to acquire or express at a higher level, a nucleic acid with 100% homology to SEQ ID NO: 4. In certain embodiments, the bacteria is a *P. acnes* bacteria. In certain embodiments, a gene with at least 80%, 90%, 95%, 98%, 99%, or 100% homology to SEQ ID NO: 4 is partially or completely deleted from the genome of the synthetic bacteria. In certain embodiments, a gene with at least 80%, 90%, 95%, 98%, 99%, or 100% homology to SEQ ID NO: 4 is disrupted by an insertion of one or more nucleotides or a introduction of a frameshift mutation in the genome of the selected, transformed, or engineered, or engineered bacteria. In certain embodiments, the selected, transformed, or engineered or selected bacteria are deoR+, Type II lipase positive, pIMPLE negative, or CRISPR Cas5 positive. In certain embodiments, the selected, transformed, or engineered or selected bacteria comprise *P. acnes* of ribotype RT1 and/or RT2.

In certain embodiments, the bacteria have been selected, transformed, or engineered for lesser expression or absence of hyaluronate lyase. In certain embodiments, the bacteria are selected, transformed, or engineered, or engineered to acquire the presence of a hyaluronidase gene. Hyaluronidase is also known as hyaluronate lyase (locus tag PPA_RS01930). In certain embodiments, the selected, transformed, or engineered, or engineered bacteria have 1.5-fold greater or lower expression or activity of hyaluronate lyase compared to a non-selected, transformed, or engineered strain. In certain embodiments, the selected, transformed, or engineered bacteria have 2-fold greater or lower expression or activity of hyaluronate lyase compared to a non-selected, transformed, or engineered strain. In certain embodiments, the selected, transformed, or engineered bacteria have 3-fold greater or lower expression or activity of hyaluronate lyase compared to a non-selected, transformed, or engineered strain. In certain embodiments, the selected, transformed, or engineered bacteria have 5-fold greater or lower expression or activity of hyaluronate lyase compared to a non-selected, transformed, or engineered strain. In certain embodiments, the selected, transformed, or engineered bacteria have 10-fold greater or lower expression or activity of hyaluronate lyase compared to a non-selected, transformed, or engineered strain. In certain embodiments, the bacteria have been selected, transformed, or engineered to acquire or express at a greater level, a nucleic acid with at least 90% homology to SEQ ID NO: 4. In certain embodiments, the bacteria have been selected, transformed, or engineered to acquire or express at a greater level, a nucleic acid with at least 95% homology to SEQ ID NO: 4. In certain embodiments, the bacteria have been selected, transformed, or engineered to acquire or express at a greater level, a nucleic acid with at least 97% homology to SEQ ID NO: 4. In certain embodiments, the bacteria have been selected, transformed, or engineered to acquire or express at higher level, a nucleic acid with at least 97% homology to SEQ ID NO: 4. In certain embodiments, the bacteria have been selected, transformed, or engineered to acquire or express at a higher level, a nucleic acid with at least 99% homology to SEQ ID NO: 4. In certain embodiments, the bacteria have been selected, transformed, or engineered to acquire or express at a higher level, a nucleic acid with 100% homology to SEQ ID NO: 4. In certain embodiments, the bacteria is a *P. acnes* bacteria. In certain embodiments, a nucleic acid with at least 80%, 90%, 95%, 98%, 99%, or 100% homology to SEQ ID NO: 4 is partially or completely deleted from the genome of the synthetic bacteria. In certain embodiments, a nucleic acid with at least 80%, 90%, 95%, 98%, 99%, or 100% homology to SEQ ID NO: 4 is disrupted by an insertion of one or more nucleotides or a introduction of a frameshift mutation in the genome of the selected, transformed, or engineered, or engineered bacteria. In certain embodiments, the selected, transformed, or engineered or selected bacteria are deoR+, Type II lipase positive, pIMPLE negative, or CRISPR Cas5 positive. In certain embodiments, the selected, transformed, or engineered or selected bacteria comprise *P. acnes* of ribotype RT1 and/or RT2.

Alanine Dehydrogenase

In some embodiments, compositions disclosed herein comprise at least one strain of bacteria, wherein the at least one strain of bacteria does not comprise an alanine dehydrogenase. In some embodiments, compositions disclosed herein comprise at least one strain of bacteria, wherein the at least one strain of bacteria does not have alanine dehydrogenase activity. In some embodiments, compositions disclosed herein comprise at least one strain of bacteria, wherein the at least one strain of bacteria does not comprise a nucleic acid encoding an alanine dehydrogenase. In certain embodiments, the bacteria have been selected, transformed, or engineered for lower expression or activity of alanine dehydrogenase relative to the bacteria before selection, transformation or engineering, respectively.

In certain embodiments, bacteria are selected, transformed, or engineered for the absence or deletion of a nucleic acid encoding alanine dehydrogenase or a portion thereof. In some embodiments, the alanine dehydrogenase is encoded by a sequence of SEQ ID NO: 5. In some embodiments, the alanine dehydrogenase is encoded by a sequence that is at least 80% homology to SEQ ID NO: 5. In certain embodiments, the bacteria are selected, transformed, or engineered for the absence or deletion of an alanine dehydrogenase or a portion thereof with at least 90% homology to SEQ ID NO: 5. In certain embodiments, the bacteria are selected, transformed, or engineered for the absence or deletion of an alanine dehydrogenase or a portion thereof with at least 95% homology to SEQ ID NO: 5. In certain embodiments, the bacteria are selected, transformed, or engineered for the absence or deletion of an alanine dehydrogenase or a portion thereof with at least 97% homology to SEQ ID NO: 5. In certain embodiments, the bacteria are selected, transformed, or engineered for the absence or deletion of an alanine dehydrogenase or a portion thereof with at least 98% homology to SEQ ID NO: 5. In certain embodiments, the bacteria are selected, transformed, or engineered for the absence or deletion of an alanine dehydrogenase or a portion thereof with at least 99% homology to SEQ ID NO: 5. In certain embodiments, a nucleic acid with at least 80%, 90%, 95%, 98%, 99%, or 100% homology to SEQ ID NO: 5 is partially or completely deleted from the selected, transformed, or engineered, or engineered bacteria. In certain embodiments, a nucleic acid with at least 80%, 90%, 95%, 98%, 99%, or 100% homology to SEQ ID NO: 5 is disrupted by an insertion of one or more nucleotides or a introduction of a frameshift mutation in the selected, transformed, or engineered bacteria. In certain embodiments, the nucleic acid is deleted by at least about 5%, at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95% or more from the 3 prime end of the nucleic acid. In certain embodiments, the nucleic acid is deleted by at least about 5%, at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95% or more from the 5 prime end of the nucleic acid.

Transposase 2

In some embodiments, compositions disclosed herein comprise at least one strain of bacteria, wherein the at least one strain of bacteria does not comprise a transposase 2. In some embodiments, compositions disclosed herein comprise at least one strain of bacteria, wherein the at least one strain of bacteria does not have transposase 2 activity. In some embodiments, compositions disclosed herein comprise at least one strain of bacteria, wherein the at least one strain of bacteria does not comprise a nucleic acid encoding a transposase 2. In certain embodiments, the bacteria have been selected, transformed, or engineered for lower expression or activity of transposase 2 relative to the bacteria before selection, transformation or engineering, respectively. In some embodiments, compositions disclosed herein comprise at least one strain of bacteria, wherein the at least one strain of bacteria does not have transposase 2 activity, expresses deoR and is of ribotype RT1.

In certain embodiments, bacteria are selected, transformed, or engineered for the absence or deletion of a nucleic acid encoding transposase 2 or a portion thereof. In some embodiments, the transposase 2 is encoded by a sequence of SEQ ID NO: 48. In some embodiments, the transposase 2 is encoded by a sequence that is at least 80% homology to SEQ ID NO: 48. In certain embodiments, the bacteria are selected, transformed, or engineered for the absence or deletion of a transposase 2 or a portion thereof with at least 90% homology to SEQ ID NO: 48. In certain embodiments, the bacteria are selected, transformed, or engineered for the absence or deletion of a transposase 2 or a portion thereof with at least 95% homology to SEQ ID NO: 48. In certain embodiments, the bacteria are selected, transformed, or engineered for the absence or deletion of a transposase 2 or a portion thereof with at least 97% homology to SEQ ID NO: 48. In certain embodiments, the bacteria are selected, transformed, or engineered for the absence or deletion of a transposase 2 or a portion thereof with at least 98% homology to SEQ ID NO: 48. In certain embodiments, the bacteria are selected, transformed, or engineered for the absence or deletion of a transposase 2 or a portion thereof with at least 99% homology to SEQ ID NO: 48. In certain embodiments, a nucleic acid with at least 80%, 90%, 95%, 98%, 99%, or 100% homology to SEQ ID NO: 48 is partially or completely deleted from the selected, transformed, or engineered, or engineered bacteria. In certain embodiments, a nucleic acid with at least 80%, 90%, 95%, 98%, 99%, or 100% homology to SEQ ID NO: 48 is disrupted by an insertion of one or more nucleotides or a introduction of a frameshift mutation in the selected, transformed, or engineered bacteria. In certain embodiments, the nucleic acid is deleted by at least about 5%, at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95% or more from the 3 prime end of the nucleic acid. In certain embodiments, the nucleic acid is deleted by at least about 5%, at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95% or more from the 5 prime end of the nucleic acid.

Additional Markers

In some embodiments, compositions disclosed herein comprise at least one strain of bacteria, wherein the at least one strain of bacteria comprises at least one protein selected from a protein that mediates biosynthesis of a polysaccharide, a protein that mediates biosynthesis of cell wall, a protein that mediates biosynthesis of amino acids, a protein that mediates carbohydrate metabolism, and a protein that mediates glycerol transportation. In some embodiments, compositions disclosed herein comprise at least one strain of bacteria, wherein the at least one strain of bacteria comprises at least one nucleic acid that encodes a protein, wherein the protein mediates biosynthesis of a polysaccharide, a protein that mediates biosynthesis of cell wall, a protein that mediates biosynthesis of amino acids, a protein that mediates carbohydrate metabolism, and a protein that mediates glycerol transportation. In some embodiments, the protein that mediates biosynthesis of a polysaccharide is a glycosyl transferase. In some embodiments, the protein that mediates biosynthesis of cell-wall is a D-alanin-D-alanine ligase. In some embodiments, the protein that mediates amino acid biosynthesis is a cobalamin-independent methionine synthase. In some embodiments, the protein is a glycerol uptake facilitator protein. In some embodiments, the protein is a protoporphyrinogen oxidase. In some embodiments, the protoporphyrinogen oxidase is encoded by a hemY gene.

In some embodiments, compositions disclosed herein comprise at least one strain of bacteria, wherein the at least one strain of bacteria comprises at least one nucleic acid encoding a protein that is selected from a glycosyl transferase, a D-alanin-D-alanine ligase, and a cobalamin-independent methionine synthase.

In certain embodiments, the bacteria have been selected, transformed, or engineered for greater expression or activity of a protein, wherein the protein is selected from a protein that mediates biosynthesis of a polysaccharide, a protein that mediates biosynthesis of cell wall, and a protein that mediates biosynthesis of amino acids. In certain embodiments, the bacteria have been selected, transformed, or engineered for greater expression or activity of a protein selected from a glycosyl transferase, a D-alanin-D-alanine ligase, and a cobalamin-independent methionine synthase.

In some embodiments, compositions disclosed herein comprise at least one strain of bacteria, wherein the at least one strain of bacteria does not comprise a Christie-Atkins-Munch-Petersen (CAMP) protein. In some embodiments, compositions disclosed herein comprise at least one strain of bacteria, wherein the at least one strain of bacteria does not comprise a CAMP1 protein. In some embodiments, compositions disclosed herein comprise at least one strain of bacteria, wherein the at least one strain of bacteria does not comprise a CAMP2 protein. In some embodiments, compositions disclosed herein comprise at least one strain of bacteria, wherein the at least one strain of bacteria does not comprise a CAMP3 protein.

In some embodiments, compositions disclosed herein comprise at least one strain of bacteria, wherein the at least one strain of bacteria does not comprise a nucleic acid encoding a CAMP protein. In certain embodiments, the bacteria have been selected, transformed, or engineered for less expression or activity of a CAMP protein relative to the bacteria that is not selected, transformed or engineered. In certain embodiments, the bacteria have been selected, transformed, or engineered for no expression or activity of a CAMP protein. In certain embodiments, the bacteria have been mutated to remove at least a portion of a nucleic acid encoding a CAMP protein. In some embodiments, the CAMP protein is selected from CAMP1, CAMP2, and CAMP3.

In some embodiments, compositions disclosed herein comprise at least one strain of bacteria, wherein the at least one strain of bacteria does not comprise a sialidase. In some embodiments, compositions disclosed herein comprise at least one strain of bacteria, wherein the at least one strain of bacteria does not comprise a nucleic acid encoding a sialidase. In certain embodiments, the bacteria have been selected, transformed, or engineered for less expression or activity of a sialidase relative to the bacteria that is not selected, transformed or engineered. In certain embodiments, the bacteria have been selected, transformed, or engineered for no expression or activity of a sialidase. In certain embodiments, the bacteria have been mutated to remove at least a portion of a nucleic acid encoding a sialidase.

In some embodiments, compositions disclosed herein comprise at least one strain of bacteria, wherein the at least one strain of bacteria does not comprise a neuramidase. In some embodiments, compositions disclosed herein comprise at least one strain of bacteria, wherein the at least one strain of bacteria does not comprise a nucleic acid encoding a neuramidase. In certain embodiments, the bacteria have been selected, transformed, or engineered for less expression or activity of a neuramidase relative to the bacteria that is not selected, transformed or engineered. In certain embodiments, the bacteria have been selected, transformed, or engineered for no expression or activity of a neuramidase. In certain embodiments, the bacteria have been mutated to remove at least a portion of a nucleic acid encoding a neuramidase.

In certain embodiments, the bacteria has been selected, transformed, or engineered for higher activity or expression of any of the following proteins: Adhesion (NCBI Accession No. 50842581); CAMP factor (NCBI Accession No. 50842175, 50842711, 50842820, 50843546); Endoglycoceramidase (NCBI Accession No. 50842131); Iron transport lipoprotein (NCBI Accession No. 50841911); Lysozyme M1 (NCBI Accession No. 50843125); Protein PAGK_237 (NCBI Accession No. 482891444); Protein PPA0532 (NCBI Accession No. 50842016); Protein PPA0533 (NCBI Accession No. 50842017); or Protein PPA1498 (NCBI Accession No. 50842976). In certain embodiments, the bacteria has been selected, transformed, or engineered with a nucleic acid encoding any of the following protein any of the following proteins: Adhesion (NCBI Accession No. 50842581); CAMP factor (NCBI Accession No. 50842175, 50842711, 50842820, 50843546); Endoglycoceramidase (NCBI Accession No. 50842131); Iron transport lipoprotein (NCBI Accession No. 50841911); Lysozyme M1 (NCBI Accession No. 50843125); Protein PAGK_237 (NCBI Accession No. 482891444); Protein PPA0532 (NCBI Accession No. 50842016); Protein PPA0533 (NCBI Accession No. 50842017); or Protein PPA1498 (NCBI Accession No. 50842976).

In certain embodiments, the bacteria has been selected, transformed, or engineered for lower activity or expression of any of the following proteins: Adhesion (NCBI Accession No. 50843565 or 50843645); Cell wall hydrolase (NCBI Accession No. 50843410); Lipase/acylhydrolase (NCBI Accession No. 50843480); NPL/P60 protein (NCBI Accession No. 50842209); Peptide ABC transporter (NCBI Accession No. 50843590); Protein PPA1197 (NCBI Accession No. 50842677); Protein PPA1281 (NCBI Accession No. 50842762); Protein PPA1715 (NCBI Accession No. 50843175); Protein PPA1939 (NCBI Accession No. 50843388); Protein PPA2239 (NCBI Accession No. 50843674); Rare lipoprotein A rlpa (NCBI Accession No. 50843612); or Triacylglycerol lipase (NCBI Accession No. 50843543). In certain embodiments, the bacteria has been selected, transformed, or engineered with a nucleotide to delete or disrupt a gene encoding any of the following proteins: Adhesion (NCBI Accession No. 50843565 or 50843645); Cell wall hydrolase (NCBI Accession No. 50843410); Lipase/acylhydrolase (NCBI Accession No. 50843480); NPL/P60 protein (NCBI Accession No. 50842209); Peptide ABC transporter (NCBI Accession No. 50843590); Protein PPA1197 (NCBI Accession No. 50842677); Protein PPA1281 (NCBI Accession No. 50842762); Protein PPA1715 (NCBI Accession No. 50843175); Protein PPA1939 (NCBI Accession No. 50843388); Protein PPA2239 (NCBI Accession No. 50843674); Rare lipoprotein A rlpa (NCBI Accession No. 50843612); or Triacylglycerol lipase (NCBI Accession No. 50843543).

In certain embodiments, bacteria disclosed herein have been selected, transformed, or engineered for lower activity or expression of any of the following proteins: HMPREF0675_4855; HMPREF0675_4856; HMPREF0675_4479; HMPREF0675_4480; HMPREF0675_4481; HMPREF0675_3655/3657; HMPREF0675_4816; HMPREF0675_4817; HMPREF0675_5205; HMPREF0675_5206; HMPREF0675_5014; HMPREF0675_5101; HMPREF0675_5159; HMPREF0675_4093/4094; HMPREF0675_4163; HMPREF0675_5031; HMPREF0675_5390; HMPREF0675_3037. In certain embodiments, the bacteria have been selected, transformed, or engineered with a nucleotide to delete or disrupt a gene encoding any of the following proteins: HMPREF0675_4855; HMPREF0675_4856; HMPREF0675_4479; HMPREF0675_4480; HMPREF0675_4481; HMPREF0675_3655/3657; HMPREF0675_4816; HMPREF0675_4817;

HMPREF0675_5205; HMPREF0675_5206; HMPREF0675_5014; HMPREF0675_5101; HMPREF0675_5159; HMPREF0675_4093/4094; HMPREF0675_4163; HMPREF0675_5031; HMPREF0675_5390; HMPREF0675_3037.

In certain embodiments, the bacteria have been selected, transformed, or engineered for higher activity or expression of any of the following proteins HMPREF0675_4855; HMPREF0675_4856; HMPREF0675_4479; HMPREF0675_4480; HMPREF0675_4481; HMPREF0675_3655/3657; HMPREF0675_4816; HMPREF0675_4817; HMPREF0675_5205; HMPREF0675_5206; HMPREF0675_5014; HMPREF0675_5101; HMPREF0675_5159; HMPREF0675_4093/4094; HMPREF0675_4163; HMPREF0675_5031; HMPREF0675_5390; HMPREF0675_3037. In certain embodiments, the bacteria has been selected, transformed, or engineered with a nucleic acid encoding any of the following proteins: HMPREF0675_4855; HMPREF0675_4856; HMPREF0675_4479; HMPREF0675_4480; HMPREF0675_4481; HMPREF0675_3655/3657; HMPREF0675_4816; HMPREF0675_4817; HMPREF0675_5205; HMPREF0675_5206; HMPREF0675_5014; HMPREF0675_5101; HMPREF0675_5159; HMPREF0675_4093/4094; HMPREF0675_4163; HMPREF0675_5031; HMPREF0675_5390; HMPREF0675_3037.

In certain embodiments, the selected, transformed, or engineered bacteria do not comprise an antibiotic resistance gene. In certain embodiments, the selected, transformed, or engineered bacteria lack an antibiotic resistance gene to any one or more of aminoglycoside, beta-lactam, colistin, fluoroquinolone, fosfomycin, fusidic acid, macrolide, lincosamide, streptogramin B, nitroimidazole, oxazolidinone, phenicol, rifampicin, sulphonamide, tetracycline, trimethoprim, or glycopeptide. In certain embodiments, an antibiotic can be applied to halt treatment with selected, transformed, or engineered bacteria disclosed herein. In certain embodiments, the antibiotic is aminoglycoside, beta-lactam, colistin, fluoroquinolone, fosfomycin, fusidic acid, macrolide, lincosamide, streptogramin B, nitroimidazole, oxazolidinone, phenicol, rifampicin, sulphonamide, tetracycline, trimethoprim, or glycopeptide.

In certain embodiments, the bacteria are selected, transformed, or engineered in order to reduce expression or release of pro-inflammatory mediators by human cells of which the bacteria contact. Bacteria may either directly or indirectly contact human cells (e.g., human skin cells). For instance, bacteria may indirectly contact human cells via factors secreted or released from the bacteria. Non-limiting example of pro-inflammatory mediators from human cells are IL-8, IL-1, IL-6, TNF-alpha, INF-alpha, and human beta defensin.

Mixtures of Different Microbes

Provided herein are compositions of a plurality of health-associated microbes. The composition of health-associated microbes may be a mixture of a plurality of different health-associated microbes. In a certain embodiment, the mixture comprises at least one selected, transformed, or engineered bacteria. In a certain embodiment, the mixture comprises at least one selected, transformed, or engineered *P. acnes*. In certain embodiments, the mixture comprises 2, 3, 4, 5, 6, 7, 8, 9, 10 or more isolated and purified species, strains, ribotypes, or phylotypes of bacteria. In a certain embodiment, the mixture comprises at least one strain of bacteria that normally colonizes a tissue or body area other than the skin. In a certain embodiment, the mixture comprises at least one strain of bacteria that normally colonizes the oral cavity. In certain embodiments, the at least one bacteria that normally colonizes the oral cavity is *S. salivarius*. In a certain embodiment, the mixture comprises at least one strain of bacteria that normally colonizes the lumen of the gastrointestinal system. In a certain embodiment, the mixture comprises at least one bacteria that normally colonizes the lumen of the gastrointestinal system is a *Lactobacillus* or a *Bifidobacterium*. In certain embodiments, the *Bifidobacterium* is *Bidifobacterium lactis* Bb-12, *Bifidobacterium animalis*, *Bifidobacterium breve*, *Bifidobacterium bifidum*, or any combination thereof. In certain embodiments, the *Lactobacillus* is *Lactobacillus acidophilus*, *Lactobacillus bulgaricus*, *Lactobacillus rhamnosus* GG, *Lactobacillus fermentumi*, *Lactobacillus Sakei*, *Lactobacillus casei*, *Lactobacillus salivarius*, *L rhamnosus* LC705, *Lactobacillus* F19 L, *Lactobacillus acidophilus* La-5, or any combination thereof. In a certain embodiment, the mixture comprises at least 2, 3, 4, 5, 6, 7, 8, 9, 10, or more different bacterial species. In a certain embodiment, the mixture comprises a mixture of at least 2, 3, 4, 5, 6, 7, 8, 9, 10, or more different bacterial strains. In a certain embodiment, the mixture contains at least one non-bacterial microbe such as a fungus, virus, or bacteriophage. Any defined mixture of a plurality of probiotic strains may be recited to "consist essentially of." This means that the mixture includes only the specified strains plus any non-active ingredient necessary for proper administration as a topical or oral formulation, such as an excipient or diluent.

In some embodiments, compositions disclosed herein comprise health-associated-microbes and probiotics especially useful for treating eczema. In some embodiments, compositions for treating eczema disclosed herein comprise *Staphylococcus Aureus*. In some embodiments, compositions for treating eczema disclosed herein comprise dead *Staphylococcus Aureus* bacteria. In some embodiments, compositions for treating eczema disclosed herein comprise *Staphylococcus hominis*. In other embodiments, the probiotic comprises of one more of a *Dermacoccus, Methlyobacterium* or *Propionibacterium* as they have a negative correlation with *S. aureus*. In other embodiments, a topical probiotic composition of *S. mitis, S. sanguinis* or *S. cristatus* are included in the probiotic.

Formulations

Provided herein, in some aspects, are compositions that comprise at least one probiotic or health-associated microbe disclosed herein, wherein the compositions are formulated for administration to a subject in need thereof. Generally, the subject is a human afflicted with acne, eczema, psoriasis, seborrheic dermatitis, rosacea, or any combination thereof. In some embodiments, a composition is formulated for topical administration to a subject in need thereof. In some embodiments, the compositions are formulated for topical administration to the skin of the subject. In some embodiments, the compositions are formulated for topical administration to the scalp of the subject. In some embodiments, a composition is formulated for oral administration. By way of non-limiting example, compositions disclosed herein comprising strains of *Lactobacillus* may be preferentially administered by oral administration. In some embodiments, a composition is formulated for transdermal administration. In some embodiments, a composition is formulated for injectable administration. In certain embodiments, the composition is a formulation selected from a gel, ointment, lotion, emulsion, paste, cream, foam, mousse, liquid, spray, suspension, dispersion and aerosol. In certain embodiments, the formulation comprises one or more excipients to provide a desired form and a desired viscosity, flow or other physical or chemical characteristic for effective application, coverage and adhesion to skin.

Compositions disclosed herein may be presented in a formulation that includes one or more excipients to improve any one or more of shelf-life, application, skin penetration, and therapeutic effect. In some embodiments, the excipient is necessary to improve any one or more of shelf-life, application, skin penetration, and therapeutic effect.

In certain embodiments, the health-associated microbe or probiotic compositions described herein are formulated for oral ingestion. The oral ingestion form may be a pill, tablet, capsule, paste, liquid suspension, colloid, or mixed with various foods such as candies, chews, yogurt, milk, cottage cheese or non-dairy based or lactose reduced substitutes. The formulation may contain additional non-active ingredients that improve flavor, smell, or texture of the edible composition. The formulation may also include binding agents, encapsulating films, or excipients that preserve shelf-life and bioavailability.

In certain embodiments, health-associated-microbes and probiotic compositions disclosed herein that are administered orally comprise a species of bacteria selected from *L. acidophilus* La-5, *Bifidobacterium animalis, Lactobacillus rhamnosus, Lactobacillus* F19, *Lactobacillus fermentum, Lactobacillus Sakei, Lactobacillus reuteri, Bifidobacterium breve, Propionibacterium freudenreichii* ssp. *Shermanii* JS, *Bifidobacterium bifidum, Lactobacillus acidophilus, Lactobacillus casei*, and *Lactobacillus salivarius*, and combinations thereof. In some embodiments, the composition comprises *Lactobacillus salivarius* and a fructo-oligosaccharide. In some embodiments, the composition comprises *Lactobacillus rhamnosus* GG. In some embodiments, the composition comprises *Lactobacillus rhamnosus* LC705. In some embodiments, the composition comprises *Lactobacillus salivarius* and a prebiotic. In some embodiments, the composition comprises hydrolyzed whey formula with *Lactobacillus rhamnosus* GG. In some embodiments, the composition comprises hydrolyzed whey formula with *Bifidobacterium lactis* Bb-12. In certain embodiments, health-associated-microbes and probiotic compositions disclosed herein that are administered orally comprise bacteria selected from *Lactobacillus rhamnosus* GG and bifidobacteria Bb-12, and a combination thereof.

An emulsion may be described as a preparation of one liquid distributed in small globules throughout the body of a second liquid. In some embodiments, the dispersed liquid is the discontinuous phase, and the dispersion medium is the continuous phase. When oil is the dispersed liquid and an aqueous solution is the continuous phase, it is known as an oil-in-water emulsion, whereas when water or aqueous solution is the dispersed phase and oil or oleaginous substance is the continuous phase, it is known as a water-in-oil emulsion. The oil phase may consist at least in part of a propellant, such as an HFA propellant. Either or both of the oil phase and the aqueous phase may contain one or more surfactants, emulsifiers, emulsion stabilizers, buffers, and other excipients. Preferred excipients include surfactants, especially non-ionic surfactants; emulsifying agents, especially emulsifying waxes; and liquid non-volatile non-aqueous materials, particularly glycols such as propylene glycol. The oil phase may contain other oily pharmaceutically approved excipients. For example, materials such as hydroxylated castor oil or sesame oil may be used in the oil phase as surfactants or emulsifiers.

A lotion may be described as a low- to medium-viscosity liquid formulation. A lotion can contain finely powdered substances that are in soluble in the dispersion medium through the use of suspending agents and dispersing agents. Alternatively, lotions can have as the dispersed phase liquid substances that are immiscible with the vehicle and are usually dispersed by means of emulsifying agents or other suitable stabilizers. In one embodiment, the lotion is in the form of an emulsion having a viscosity of between 100 and 1000 centistokes. The fluidity of lotions permits rapid and uniform application over a wide surface area. Lotions are typically intended to dry on the skin leaving a thin coat of their medicinal components on the skin's surface.

A cream may be described as a viscous liquid or semi-solid emulsion of either the "oil-in-water" or "water-in-oil type". Creams may contain emulsifying agents and/or other stabilizing agents. In one embodiment, the formulation is in the form of a cream having a viscosity of greater than 1000 centistokes, typically in the range of 20,000-50,000 centistokes. Creams are often time preferred over ointments as they are generally easier to spread and easier to remove.

The basic difference between a cream and a lotion is the viscosity, which is dependent on the amount/use of various oils and the percentage of water used to prepare the formulations. Creams are typically thicker than lotions, may have various uses and often one uses more varied oils/butters, depending upon the desired effect upon the skin. In a cream formulation, the water-base percentage is about 60-75% and the oil-base is about 20-30% of the total, with the other percentages being the emulsifier agent, preservatives and additives for a total of 100%.

An ointment may be described as a semisolid preparation containing an ointment base and optionally one or more active agents of this disclosure. Examples of suitable ointment bases include hydrocarbon bases (e.g., petrolatum, white petrolatum, yellow ointment, and mineral oil); absorption bases (hydrophilic petrolatum, anhydrous lanolin, lanolin, and cold cream); water-removable bases (e.g., hydrophilic ointment), and water-soluble bases (e.g., polyethylene glycol ointments). Pastes typically differ from ointments in that they contain a larger percentage of solids. Pastes are typically more absorptive and less greasy that ointments prepared with the same components.

A gel may be described as a semisolid system containing dispersions of small or large molecules in a liquid vehicle that is rendered semisolid by the action of a thickening agent or polymeric material dissolved or suspended in the liquid vehicle. The liquid may include a lipophilic component, an aqueous component or both. Some emulsions may be gels or otherwise include a gel component. Some gels, however, are not emulsions because they do not contain a homogenized blend of immiscible components. Suitable gelling agents include, but are not limited to, modified celluloses, such as hydroxypropyl cellulose and hydroxyethyl cellulose; Carbopol homopolymers and copolymers; and combinations thereof. Suitable solvents in the liquid vehicle include, but are not limited to, diglycol monoethyl ether; alkene glycols, such as propylene glycol; dimethyl isosorbide; alcohols, such as isopropyl alcohol and ethanol. The solvents are typically selected for their ability to dissolve the drug. Other additives, which improve the skin feel and/or emolliency of the formulation, may also be incorporated. Examples of such additives include, but are not limited, isopropyl myristate, ethyl acetate, C12-C15 alkyl benzoates, mineral oil, squalane, cyclomethicone, capric/caprylic triglycerides, and combinations thereof.

Foams may be described as an emulsion in combination with a gaseous propellant. The gaseous propellant consists primarily of hydrofluoroalkanes (HFAs). Suitable propellants include HFAs such as 1,1,1,2-tetrafluoroethane (HFA 134a) and 1,1,1,2,3,3,3-heptafluoropropane (HFA 227), but mixtures and admixtures of these and other HFAs that are currently approved or may become approved for medical use are suitable. The propellants preferably are not hydrocarbon propellant gases which can produce flammable or explosive vapors during spraying. Furthermore, the compositions preferably contain no volatile alcohols, which can produce flammable or explosive vapors during use.

Emollients may be described as externally applied agents that soften or soothe skin and are generally known in the art and listed in compendia, such as the "Handbook of Pharmaceutical Excipients", 4.sup.th Ed., Pharmaceutical Press, 2003. In certain embodiments, the emollients are almond oil, castor oil, ceratonia extract, cetostearoyl alcohol, cetyl alcohol, cetyl esters wax, cholesterol, cottonseed oil, cyclomethicone, ethylene glycol palmitostearate, glycerin, glycerin monostearate, glyceryl monooleate, isopropyl myristate, isopropyl palmitate, lanolin, lecithin, light mineral oil, medium-chain triglycerides, mineral oil and lanolin alcohols, petrolatum, petrolatum and lanolin alcohols, soybean oil, starch, stearyl alcohol, sunflower oil, xylitol and combinations thereof. In one embodiment, the emollients are ethylhexylstearate and ethylhexyl palmitate.

Surfactants are surface-active agents that lower surface tension and thereby increase the emulsifying, foaming, dispersing, spreading and wetting properties of a product. In certain embodiments, suitable non-ionic surfactants include emulsifying wax, glyceryl monooleate, polyoxyethylene alkyl ethers, polyoxyethylene castor oil derivatives, polysorbate, sorbitan esters, benzyl alcohol, benzyl benzoate, cyclodextrins, glycerin monostearate, poloxamer, povidone and combinations thereof. In one embodiment, the non-ionic surfactant is stearyl alcohol.

Emulsifiers are surface active substances which promote the suspension of one liquid in another and promote the formation of a stable mixture, or emulsion, of oil and water. In certain embodiments, the emulsifiers are metallic soaps, certain animal and vegetable oils, and various polar compounds. Suitable emulsifiers include acacia, anionic emulsifying wax, calcium stearate, carbomers, cetostearyl alcohol, cetyl alcohol, cholesterol, diethanolamine, ethylene glycol palmitostearate, glycerin monostearate, glyceryl monooleate, hydroxypropyl cellulose, hypromellose, lanolin, hydrous, lanolin alcohols, lecithin, medium-chain triglycerides, methylcellulose, mineral oil and lanolin alcohols, monobasic sodium phosphate, monoethanolamine, nonionic emulsifying wax, oleic acid, poloxamer, poloxamers, polyoxyethylene alkyl ethers, polyoxyethylene castor oil derivatives, polyoxyethylene sorbitan fatty acid esters, polyoxyethylene stearates, propylene glycol alginate, self-emulsifying glyceryl monostearate, sodium citrate dehydrate, sodium lauryl sulfate, sorbitan esters, stearic acid, sunflower oil, tragacanth, triethanolamine, xanthan gum and combinations thereof. In one embodiment, the emulsifier is glycerol stearate. In one embodiment, the emulsifier is glycerol. In one embodiment, the emulsifier is glycerin.

In some embodiments, compositions disclosed herein are formulated to be applied to a subject's scalp. In some embodiments, the composition is formulated to be used as a product selected from a shampoo, a conditioner, a mousse, a gel, and a spray. Such compositions would be useful for the treatment of seborrheic dermatitis. Treatment of seborrheic dermatitis with such compositions may result in the reduction of a symptom selected from dandruff and cradle cap. However, compositions disclosed herein may be used to treat seborrheic dermatitis at other areas of the body besides the scalp. Non-limiting examples of other areas include the chest, stomach, skin folds, arms, legs, groin area and under breasts.

In some embodiments, compositions disclosed herein comprise a buffer, wherein the buffer controls a pH of the composition. Preferably, the buffers buffer the composition from a pH of about 4 to a pH of about 7.5, from a pH of about 4 to a pH of about 7, and from a pH of about 5 to a pH of about 7.

In some embodiments, compositions disclosed herein are formulated to provide or maintain a desirable skin pH. In some embodiments, the desirable skin pH is between about 4.5 and about 6.5. In some embodiments, the desirable skin pH is between about 5 and about 6. In some embodiments, the desirable skin pH is about 5.5. In some embodiments, compositions disclosed herein are formulated with a skin pH modulating agent. Non-limiting examples of pH modulating agents include salicylic acid, glycolic acid, trichloroacetic acid, azeilic acid, lactic acid, aspartic acid, hydrochloride, stearic acid, glyceryl stearate, cetyl palmitate, urea phosphate, and tocopheryl acetate.

In some embodiments, compositions disclosed herein are formulated to provide more oxygen to the skin. In some embodiments, compositions disclosed herein are formulated to provide more oxygen exposure to the skin. In some embodiments, compositions disclosed herein are formulated to provide more oxygen diffusion into the skin. In some embodiments, compositions disclosed herein are formulated to provide more oxygen diffusion through the skin. In some embodiments, compositions disclosed herein are formulated with an agent that provides more oxygen to the skin. In some embodiments, compositions disclosed herein are used with an agent that provides more oxygen to the skin. In some embodiments, compositions disclosed herein are used before use of an agent that provides more oxygen to the skin. In some embodiments, compositions disclosed herein are used after use of an agent that provides more oxygen to the skin. A non-limiting example of an agent that provides oxygen to the skin is chlorophyll.

Preservatives can be used to prevent the growth of fungi and microorganisms. Suitable antifungal and antimicrobial agents include, but are not limited to, benzoic acid, butylparaben, ethyl paraben, methyl paraben, propylparaben, sodium benzoate, sodium propionate, benzalkonium chloride, benzethonium chloride, benzyl alcohol, cetylpyridinium chloride, chlorobutanol, phenol, phenylethyl alcohol, and thimerosal. In one embodiment, a concentration of a preservative that is effective to prevent fungal growth is selected, without affecting the effectiveness of the composition for its intended purposed upon topical application.

Excipients in the formulation are selected based on the type of formulation intended. In certain embodiments, the excipients include gelatin, casein, lecithin, gum acacia, cholesterol, tragacanth, stearic acid, benzalkonium chloride, calcium stearate, glyceryl monostearate, cetostearyl alcohol, cetomacrogol emulsifying wax, sorbitan esters, polyoxyethylene alkyl ethers, polyoxyethylene castor oil derivatives, polyoxyethylene sorbitan fatty acid esters, polyethylene glycols, polyoxyethylene stearates, colloidol silicon dioxide, phosphates, sodium dodecyl sulfate, carboxymethylcellulose calcium, carboxymethylcellulose sodium, methylcellulose, hydroxyethylcellulose, hydroxypropylcellulose, hydroxypropylmethycellulose phthalate, noncrystalline cellulose, magnesium aluminum silicate, triethanolamine, polyvinyl alcohol, polyvinylpyrrolidone, sugars, and starches.

In some embodiments, compositions disclosed herein are formulated with glycerol. In some instances, a strain of bacteria in the composition ferments the glycerol, thereby producing short chain fatty acids. Non-limiting examples of short-chain fatty acids include acetic acid, lactic acid, and propionic acid. In some embodiments, the strain of bacteria is a *Propionibacterium* strain. In some embodiments, the strain of bacteria is a *P. acnes* strain.

Penetration enhancers are frequently used to promote transdermal delivery of drugs across the skin, in particular across the stratum corneum. Some penetration enhancers cause dermal irritation, dermal toxicity and dermal allergies. However, the more commonly used ones include urea, (carbonyldiamide), imidurea, N,N-diethylformamide, N-methyl-2-pyrrolidine, 1-dodecal-azacycloheptane-2-one, calcium thioglycate, 2-pyyrolidine, N,N-diethyl-m-toluamide, oleic acid and its ester derivatives, such as methyl, ethyl, propyl, isopropyl, butyl, vinyl and glyceryl-monooleate, sorbitan esters, such as sorbitan monolaurate and sorbitan monooleate, other fatty acid esters such as isopropyl laurate, isopropyl myristate, isopropyl palmitate, diisopropyl adipate, propylene glycol monolaurate, propylene glycol monooleatea and non-ionic detergents such as BRIJ® 76 (stearyl poly(10) oxyethylene ether), BRIJ® 78 (stearyl poly(20)oxyethylene ether), BRIJ® 96 (oleyl poly (10)oxyethylene ether), and BRIJ® 721 (stearyl poly (21) oxyethylene ether) (ICI Americas Inc. Corp.).

The composition can be formulated to comprise the health-associated microbe or probiotic at a particular concentration. For example, the composition can comprise an amount of probiotic such that the microorganisms may be delivered in effective amounts. In certain embodiments, the amount of probiotic delivered is at least $1\times10^3$, $1\times10^4$, $1\times10^5$, $1\times10^6$, $1\times10^7$, $1\times10^8$, $1\times10^9$, $1\times10^{10}$ colony forming units per unit dose. The composition may be formulated with the health-associated microbe or probiotic in a proportion of at least about 0.0001% (expressed by dry weight), from about 0.0001% to about 99%, from about 0.001% to about 90% by weight, from about 0.01% to about 80% by weight, and from about 0.1% to about 70% by weight, relative to the total weight of the composition. In general, a composition intended to be administered topically comprises at least $1\times10^3$, $1\times10^4$, $1\times10^5$, $1\times10^6$, $1\times10^7$, $1\times10^8$, $1\times10^9$, $1\times10^{10}$ microorganisms per gram of carrier, or at equivalent doses calculated for inactive or dead microorganisms or for bacterial fractions or for metabolites produced.

Microbes disclosed herein may be delivered in effective amounts per unit dose, of at least about $1\times10^2$ colony forming units (cfu) to about $1\times10^{20}$ cfu. In the particular case of the compositions that have to be administered topically, the concentration of each bacterial strain and/or corresponding fraction and/or metabolite can be adjusted so as to correspond to doses (expressed as bacterial equivalent) ranging from about $1\times10^5$ to about $1\times10^{12}$ cfu/dose.

Compositions disclosed herein for topical application generally comprise from about $1\times10^2$ to about $1\times10^{15}$ cfu/g, from about $1\times10^5$ to about $1\times10^{12}$ cfu/g, or from about $1\times10^6$ to about $10\times10^{12}$ cfu/g of bacteria.

In certain embodiments, compositions disclosed herein are formulated in order to deliver at least $10^6$ microbes per $cm^2$ of skin. In certain embodiments, the composition is formulated in order to deliver at least $10^7$ microbes per $cm^2$ of skin. In certain embodiments, the composition is formulated in order to deliver at least $10^8$ microbes per $cm^2$ of skin.

In certain embodiments, the composition is formulated in order to deliver at least $10^9$ microbes per $cm^2$ of skin. In certain embodiments, the composition is formulated in order to deliver less than $10^9$ microbes per $cm^2$ of skin. In certain embodiments, the composition is formulated in order to deliver less than $10^8$ microbes per $cm^2$ of skin. In certain embodiments, the composition is formulated in order to deliver less than $10^7$ microbes per $cm^2$ of skin. In certain embodiments, the composition is formulated in order to deliver between about $10^7$ and $10^8$ microbes per $cm^2$ of skin. In certain embodiments, the composition is formulated in order to deliver between about $10^6$ microbes per $cm^2$ of skin and about $10^{10}$ microbes per $cm^2$ of skin. In certain embodiments, the composition is formulated in order to deliver between about $10^6$ microbes per $cm^2$ of skin and about $10^9$ microbes per $cm^2$ of skin. In certain embodiments, the composition is formulated in order to deliver between about $10^7$ microbes per $cm^2$ of skin and about $10^{10}$ microbes per $cm^2$ of skin. In certain embodiments, the composition is formulated in order to deliver between about $10^7$ microbes per $cm^2$ of skin and about $10^9$ microbes per $cm^2$ of skin.

In certain embodiments, compositions disclosed herein are formulated at a concentration of about $10^5$ microbes per milliliter to about $10^{12}$ microbes per milliliter. In certain embodiments, compositions disclosed herein are formulated at a concentration of about $10^6$ microbes per milliliter. In certain embodiments, compositions disclosed herein are formulated at a concentration of about $10^7$ microbes per milliliter. In certain embodiments, compositions disclosed herein are formulated at a concentration of about $10^8$ microbes per milliliter. In certain embodiments, compositions disclosed herein are formulated at a concentration of about $10^9$ microbes per milliliter. In certain embodiments, compositions disclosed herein are formulated at a concentration of about $10^{10}$ microbes per milliliter.

In certain embodiments, compositions disclosed herein for topical or oral use contain biologic stability compounds including but not limited to carbohydrates such as trehalose, mannose, fructose, glucose, sucrose, lactose, raffinose, stachyose, melezitose, dextran, and sugar alcohols; and/or cryopreservatives such as glycerol, bovine-free media, (e.g., tryptic soy broth), whey protein, NaCl, phosphate buffer, MgCl, lyophilized bacteria, or other inactive/killed bacteria.

After formulation, composition disclosed herein may be packaged in a manner suitable for delivery and use by an end user. In one embodiment, the composition is placed into an appropriate dispenser and shipped to the end user. Examples of a final container may include a pump bottle, squeeze bottle, jar, tube, capsule or vial.

In some embodiments, compositions disclosed herein can be added to an applicator before packaging. Non-limiting examples of applicators include a cotton pad, a polyester pad, a q-tip, a sponge, and a brush. In some embodiments, the applicator is placed in a package. Non-limiting examples of a package includes bags and foil or wax lined paper packets. The interior of the package may be sterile. In some embodiments, air in the package is removed with a vacuum before sealing. In some embodiments, the package is heat-sealed. In some embodiments, the package is sealed with adhesive.

In another embodiment, compositions disclosed herein are lyophilized or freeze dried, for reconstitution before application to the skin. In one embodiment, lyophilization or freeze drying is conducted with one or more excipients, such as glycerol or other sugar alcohols, to improve the shelf life of the selected, transformed, or engineered bacteria. In one embodiment, the lyophilized composition does not include trehalose (.alpha.-D-glucopyranosyl-1,1-.alpha.-D-glucopyranosyde). In some embodiments, the composition does not have to be frozen.

Compositions disclosed herein may be packaged in one or more containers. For example, a single bottle, tube, container, or capsule may be divided to two equal or unequal parts wherein one part contains the bacteria, in their packing form (freeze dried/inactive, etc.), and the other part contains an activation material, which can be a liquid or a gel. The single bottle or container can be designed so that an end user can dispense with a single force applied to the container all or a portion of the contents in the two container parts, to dispense onto the skin or other surface the selected, transformed, or engineered bacteria and the activation material. The kit may also be of the form that comprises two or more containers, one container with the population(s) of selected, transformed, or engineered bacteria and the other with a formulation for admixture with the populations of selected, transformed, or engineered bacteria. In another example, two or more containers, one container with the population of selected, transformed, or engineered bacteria, the other container with natural nonpathogenic skin bacteria that are not selected, transformed, or engineered, and a third container with a formulation for admixture with the populations of selected, transformed, or engineered bacteria. In another example, the two or more containers composing the single bottle had one pump connected to two separate tubes, each draining from a different chamber. The kit may also include one or more complementary products, such as soaps, body washes or moisturizing lotions with certain pH, lotions or creams containing active compounds, bacteria and limiting factors etc. In another embodiment, the complementary product is a limiting factor that will enhance the growth, activity and/or expression of the compound of interest to provide a lasting or continuous expression of the compound. The complementary product may include any compound beneficial to the activity of the original product, and enhance its activity for lasting efficacy. Another contemplated packaging is one wherein the population of selected, transformed, or engineered bacteria is maintained as a layer on a bandage or film that is combined with a second layer of bandage/film that will allow activation of the bacteria, and that optionally may also limit reproduction/growth factors. In another embodiment, the final product is stored refrigerated, with the bacteria being in their active state. In another embodiment, the bacteria are stored in a small bead of water soluble cellulose. The beads can be mixed in any solution such as sunscreen/moisturizing/body wash or soap.

In yet another embodiment, this disclosure provides for compositions comprising a healthy skin microbiome transplant. Healthy skin microbiome transplants disclosed herein comprise a population of bacteria harvested from healthy or normal skin. Healthy skin microbiome transplants disclosed herein can be characterized as microbiomes that induce a low level of human inflammatory mediators (at the RNA and/or protein level) from a population of human cells when the microbiome is incubated with the population of human cells. The population of human cells may be a subject's own keratinocytes. The population of human cells may be pooled keratinocytes. Non-limiting examples of inflammatory mediators include acne associated inflammatory markers such as IL-8, IL-6, TNF-alpha, INF-alpha, IL-1, and beta defensin. Methods of measuring levels of these mediators either at the mRNA, protein or functional level are known in the art and include, quantitative real-time PCR, northern blot, RNA-seq, microarray, ELISA, homogenous protein assays, immunoblot, or mass spectrometry.

In yet other embodiments are compositions comprising an individual's own modified microbiome. Compositions comprising an individual's own modified microbiome may be obtained by methods disclosed herein. In some embodiments, the individual's own modified microbiome is produced by harvesting or capturing the individual's own microbiome (e.g., from a skin swab), culturing the microbiome, and removing at least one inflammatory strain of bacteria. In some embodiments, the individual's own modified microbiome is produced by harvesting or capturing the individual's own microbiome (e.g., from a skin swab), culturing the microbiome, and removing at least one pathogenic strain of bacteria. In some embodiments, an inflammatory strain is a pathogenic strain. In some embodiments, an inflammatory strain or pathogenic strain is identified by incubating the strain with keratinocytes and detecting production of inflammatory mediators from the keratinocytes. In some embodiments, an inflammatory strain or pathogenic strain is identified by incubating the strain with keratinocytes and quantifying production of inflammatory mediators from the keratinocytes (e.g., the strain produces higher levels of inflammatory mediators from the keratinocytes than a health-associated strain disclosed herein). In some embodiments, an inflammatory strain or pathogenic strain is identified by incubating the strain with keratinocytes and detecting undesirable keratinocyte gene expression or undesirable keratinocyte activity. Undesirable keratinocyte gene expression or undesirable keratinocyte activity would generally be understood by one skilled in the art to mean expression or activity in keratinocytes that promotes a skin disorder. In some instances, the keratinocytes are the subject's keratinocytes. In some instances, the keratinocytes are pooled keratinocytes. In some instances, methods comprise identifying and removing known acne associated strains such as, by way of non-limiting example, some *P. acnes* strains of ribotypes RT4 and RT5, and clade Ia bacteria. In some instances, methods comprise identifying and selecting only non-inflammatory strains identified by the method above or known to be associated with healthy skin and introducing the modified biome to the patient. Non-limiting examples of non-inflammatory strains include *P. acnes* strains of ribotypes RT2, RT6, and clade II bacteria.

In yet another embodiment is a composition comprising a microbiome from a healthy individual's stool. These compositions may be referred to herein as a "fecal transplant." In some embodiments, the microbiome is a complete microbiome of a healthy individual's stool. In some embodiments, the microbiome is a partial microbiome of a healthy individual's stool. In some instances, the healthy individual does not have acne. In some instances, the healthy individual does not have an inflammatory condition. In some instances, the healthy individual does not have an inflammatory skin condition. Non-limiting examples of inflammatory conditions are acne, eczema, psoriasis, seborrheic dermatitis, rosacea, lupus, pemphigus, pemphigoid, scleroderma, alopecia areata, lichen sclerosis, lichen planus, pruritus, prurigo nodularis, lichen simplex chronicus, inflammatory bowel disease, colitis, irritable bowel syndrome, atherosclerosis, CAD, diabetes, HIV, and cancer. In some embodiments, the healthy individual is not a tissue transplant patients, is not taking an immunosuppressive drug, or is not currently/recently (within 12 weeks) receiving an antibiotic therapy. In some embodiments, the microbiome comprises strains of bacteria that produce no inflammatory mediators when co-incubated colonic mucosal cells. In some embodiments, strains of bacteria that produce no inflammatory mediators when co-incubated colonic mucosal cells are identified by 16S, 18S, or whole genome sequencing. In some embodiments, the partial microbiome is a modified microbiome, wherein the modified microbiome is derived from a fecal transplant by removing pathogenic strains or introducing health-associated strains.

Additional Active Ingredients

Compositions disclosed herein may comprise additional active ingredients. In certain embodiments, compositions disclosed herein comprise at least one non-living, non-microbial constituent. By way of non-limiting example, the non-living, non-microbial constituent may be selected from a small molecule, a fatty acid, an antibiotic, a metabolite, an antioxidant, and a retinoid. Non-limiting examples of antioxidants are vitamin C and vitamin E. Non-limiting examples of a retinoid are tretinoin, tazarotene, adapalene, and retinol. In some embodiments, the non-living, non-microbial constituent is vitamin D, which may be in the form of calciptotriene. In some embodiments, the additional active ingredient is an agent that has anti-inflammatory activity.

In certain embodiments, the composition contains an antibiotic. Non-limiting examples of antibiotics include macrolide, tetracycline, β-lactam, aminoglycoside, cephalosporin, carbapenems, quinolone/fluoroquinolone, sulfonamides, salicylic acid, glycolic acid, azaleic acid, live phage therapy, synthetic phage contractile nanotubes, laser, dapsone, benzoyl peroxide, benzoyl peroxide/resveratrol combinations, and any combination thereof. In some embodiments, the antibiotic is selected from clindamycin, doxycycline, erythromycin, and tetracycline, wherein the antibiotic is formulated for topical administration. In some embodiments, the antibiotic is selected from erythromycin, tetracycline, doxycycline and minocycline, wherein the antibiotic is formulated for oral administration.

In certain embodiments, a composition disclosed herein comprises a topical anti-acne medication such as benzoyl peroxide or salicylic acid. The concentration of benzoyl peroxide or salicylic acid included in a composition may be lower than that commonly included in a single formulation (without a health-associated microbe or probiotic). In some embodiments, the concentration of the anti-acne medication is between about 0.1% and about 3%. In some embodiments, the concentration of the anti-acne medication is between about 0.1% and about 2.5%. In some embodiments, the concentration of the anti-acne medication is between about 0.5% and about 2.5%. In some embodiments, the concentration of the anti-acne medication is between about 1% and about 2.5%. In some embodiments, the concentration of the anti-acne medication is less than about 2.5%. In some embodiments, the concentration of the anti-acne medication is less than about 2%. In some embodiments, the concentration of the anti-acne medication is less than about 1.5%. In some embodiments, the concentration of the anti-acne medication is less than about 1%. In some embodiments, the concentration of the anti-acne medication is less than about 0.5%. In some embodiments, the concentration of the anti-acne medication is less than about 0.1%.

In certain embodiments, compositions disclosed herein comprise a topical anti-acne medication such as a retinoid. Non-limiting examples of topical retinoid compounds include retinoic acid, tretinoin, adapalene, and tazarotene. In certain embodiments, compositions disclosed herein comprise resveratrol or trans-resveratrol. In some embodiments, the concentration of the retinoid or resveratrol in the composition is less than about 10%. In some embodiments, the concentration of the retinoid or resveratrol in the composition is less than about 5%. In some embodiments, the concentration of the retinoid or resveratrol in the composition is less than about 2.5%. In some embodiments, the concentration of the retinoid or resveratrol in the composition is less than about 1%. In some embodiments, the concentration of the retinoid or resveratrol in the composition is less than about 0.5%. In some embodiments, the concentration of the retinoid or resveratrol in the composition is between about 0.5% and about 10%. In some embodiments, the concentration of the retinoid or resveratrol in the composition is between about 1% and about 10%. In some embodiments, the concentration of the retinoid or resveratrol in the composition is between about 0.5% and about 2.5%.

In some embodiments, compositions disclosed herein comprise at least one omega-3 fatty acid. Non-limiting examples of omega-3 fatty acids include hexadecatrienoic acid (HTA), α-Linolenic acid (ALA), stearidonic acid (SDA), eicosatrienoic acid (ETE), eicosatetraenoic acid (ETA), eicosapentaenoic acid (EPA), heneicosapentaenoic acid (HPA), docosapentaenoic acid (DPA), clupanodonic acid, docosahexaenoic acid (DHA), tetracosapentaenoic acid, tetracosahexaenoic acid (nisinic acid), and phytosphingosine.

In some embodiments, compositions disclosed herein comprise an acid selected from glycolic acid, azaelic acid, and trichloroacetic acid. In some embodiments, compositions disclosed herein comprise a natural extract, such as tea tree oil or green tea extract.

In some embodiments, the additional active ingredient comprises a drug targeting at least one strain of *P. acnes*. In some embodiments, the drug targeting at least one strain of *P. acnes* is a small molecule drug. In some embodiments, the drug targeting at least one strain of *P. acnes* is a small molecule inhibitor of an enzyme expressed by *P. acnes*. In some embodiments, the enzyme expressed by *P. acnes* is required for *P. acnes* growth or *P. acnes* energy metabolism. In some embodiments, the drug targeting at least one strain of *P. acnes* is a biologic. In some embodiments, the biologic comprises a peptide. In some embodiments, the biologic comprises an antibody or antigen binding fragment. In some embodiments, the biologic comprises and antibody-small molecule conjugate. In some embodiments, the biologic comprises and antibody-drug conjugate. In some embodiments, the biologic comprises a nucleic acid. In some embodiments, then nucleic acid comprises an antisense nucleic acid molecule, wherein the antisense nucleic acid molecule inhibits an enzyme expressed by *P. acnes*. In some embodiments, the enzyme expressed by *P. acnes* is required for *P. acnes* growth or *P. acnes* energy metabolism. In some embodiments, the antisense nucleic acid molecule comprises siRNA. In some embodiments, the antisense nucleic acid molecule comprises a shRNA. In some embodiments, the antisense nucleic acid molecule comprises a guide RNA to be used with a CRISPR-associated protease. In some embodiments, the additional active ingredient (e.g., guide RNA and CRISPR-associated protease) and targets a genomic element specific for strains of *P. acnes* associated with acne.

Methods of Treating Skin Disorders

Provided herein, in some aspects, are methods for treating or preventing skin disorders disclosed herein. In some aspects, the methods comprise administering a strain of bacteria disclosed herein, wherein the strain of bacteria is incorporated into a pharmaceutical composition. In some aspects, the methods comprise administering a composition disclosed herein. In some aspects, the disclosure provides methods for treating or preventing acne. Methods for treating or preventing acne generally comprise administering an effective amount of a strain of bacteria disclosed herein to the skin of a subject in need thereof. In some embodiments, methods comprise administering at least one composition disclosed herein. In some embodiments, methods comprise administering at least one species of bacteria disclosed herein. In some embodiments, methods comprise administering at least one strain of bacteria disclosed herein. In some embodiments, methods comprise administering at least one ribotype of bacteria disclosed herein. In some embodiments, methods comprise administering at least one probiotic disclosed herein. In some embodiments, methods comprise administering at least one health-associated microbe disclosed herein. In some embodiments, methods comprise administering at least one selected species of selected bacteria disclosed herein. In some embodiments, methods comprise administering at least one selected strain of selected bacteria disclosed herein. In some embodiments, methods comprise administering at least one selected, transformed, or engineered bacteria disclosed herein. In some embodiments, methods comprise administering at least one genetically modified bacteria disclosed herein. In some embodiments, methods comprise administering at least one genetically engineered bacteria disclosed herein. In some embodiments, methods comprise administering at least one health-associated strain of bacteria described herein.

In some embodiments, methods disclosed herein comprise administering an isolated strain of bacteria. In some embodiments, methods disclosed herein comprise administering an isolated strain of bacteria. In some embodiments, methods disclosed herein comprise administering a purified strain of bacteria. In some embodiments, methods disclosed herein comprise administering a purified and isolated strain of bacteria. In some embodiments, methods disclosed herein comprise selecting, isolating, or purifying a strain of bacteria. Selecting, isolating or purifying may comprise isolating a single clone of bacteria and propagating it to obtain a selected, isolated, or purified strain. In some embodiments, the methods comprise selecting, isolating or purifying a plurality of strains of bacteria to obtain at least a first selected, isolated, or purified strain and a second selected, isolated, or purified strain. In some embodiments, the methods further comprise combining the first selected, isolated, or purified strain and the second selected, isolated, or purified strain in a pharmaceutical composition. In some embodiments, the first selected, isolated, or purified strain or the second selected, isolated, or purified strain is selected from strains disclosed herein.

In some embodiments, the first selected, isolated, or purified strain and the second selected, isolated, or purified strain are selected from strains disclosed herein.

In some embodiments, methods comprise administering at least one health-associated strain of bacteria selected from a health-associated strain of *Propionibacterium, Staphylococcus* and *Lactobacillus* bacteria. In some embodiments, methods comprise administering at least one health-associated strain of *Propionibacterium* bacteria. In some embodiments, methods comprise administering at least one health-associated strain selected from a health-associated strain of *P. acnes*, a health-associated strain of *P. granulosum*, a health-associated strain of *P. avidum*, a health-associated strain of *P. acnes* subsp. *defendens*, and a health-associated *Staphylococcus*, as described herein. In some embodiments, the health-associated strain of *P. acnes* is not *P. acnes* subsp. *acnes*. In some embodiments, methods comprise administering at least one health-associated strain of *P. acnes*. In some embodiments, methods comprise administering at least one health-associated fungus. The health-associated fungus may be *Malassezia*.

In some embodiments, the methods comprise administering a microbe disclosed herein. In some embodiments, the methods comprise administering a mixture of at least two microbes disclosed herein. In some embodiments, the methods comprise administering at least one health-associated microbe disclosed herein. In some embodiments, the microbe is a fungus. In some embodiments, the microbe is a protist. In some embodiments, the microbe is bacteria. In some embodiments, the bacteria comprise a strain of *Propionibacterium* bacteria. In some embodiments, the bacteria comprise a strain of *P. acnes*. In some embodiments, the bacteria comprise a strain of *P. avidum*. In some embodiments, the bacteria comprise a strain of *P. granulosum*. In some embodiments, the bacteria comprise a strain of *P. acnes* subsp. *defendens*. In some embodiments, the bacteria consist essentially of at least one strain of *P. acnes*. In some embodiments, the bacteria consist essentially of at least one strain of *P. avidum*. In some embodiments, the bacteria consist essentially of at least one strain of *P. granulosum*. In some embodiments, the bacteria consist essentially of at least one strain of *P. acnes* subsp. *defendens*.

In some embodiments, methods comprise administering a composition disclosed herein. In some embodiments, methods comprise administering a composition having a formulation disclosed herein.

In certain embodiments, methods disclosed herein comprise applying an effective amount of a composition containing a plurality of microbes of different ribotypes. In certain embodiments, the strain is a *P. acnes* strain of a ribotype selected from RT1, RT2, RT3, RT4, RT5, RT7, RT8, RT9, and RT10. In certain embodiments, the strain is a *P. acnes* strain of a ribotype selected from RT1, RT2, RT3, RT7, RT8, RT9, and RT10. In certain embodiments, the plurality of microbes is a mixture of two or more *P. acnes* strains of different ribotypes. In certain embodiments, the different ribotypes comprise RT1 and RT2. In certain embodiments, the different ribotypes comprises RT1 and RT3. In certain embodiments, the different ribotypes comprise RT1 and not RT6. In certain embodiments, the different ribotypes comprise RT2 and RT3. In certain embodiments, the v comprises RT2 and not RT6. In certain embodiments, the different ribotypes comprise RT2 and RT3. In certain embodiments, the different ribotypes comprise RT3 and not RT6. In certain embodiments, the different ribotypes consist essentially of RT1 and RT2. In certain embodiments, the different ribotypes consist essentially of RT1 and RT3. In certain embodiments, the different ribotypes consist essentially of RT1 and not RT6. In certain embodiments, the different ribotypes consist essentially of RT2 and RT3. In certain embodiments, the different ribotypes consist essentially of RT2 and not RT6. In certain embodiments, the different ribotypes consist essentially of RT2 and RT3. In certain embodiments, the different ribotypes consist essentially of RT3 and not RT6. In certain embodiments the mixture does not comprise ribotype RT6.

In certain embodiments, methods described herein comprise applying an effective amount of a composition containing a plurality of microbes of different ribotypes. In certain embodiments, the plurality of microbes is a mixture of three or more *P. acnes* strains of different ribotypes. In certain embodiments, the mixture comprises RT1, RT2, and RT3. In certain embodiments, the mixture comprises RT2, RT3, and not RT6. In certain embodiments, the mixture comprises RT1, RT2, and RT6. In certain embodiments, the mixture comprises RT1, RT3, and not RT6. In certain embodiments, the mixture consists essentially of RT1, RT2, and RT3. In certain embodiments, the mixture consists essentially of RT2, RT3, and not RT6. In certain embodiments, the mixture consists essentially of RT1, RT2, and not RT6. In certain embodiments, the mixture consists essentially of RT1, RT3, and not RT6. In certain embodiments the mixture does not comprise RT6.

Methods described herein comprise applying probiotics of various strains. Compositions described herein comprise various strains of bacteria. In certain embodiments, the strain has at least 50% homology to a strain described herein. In certain embodiments, the strain has at least 60% homology to a strain described herein. In certain embodiments, the strain has at least 70% homology to a strain described herein. In certain embodiments, the strain has at least 80% homology to a strain described herein. In certain embodiments, the strain has at least 90% homology to a strain described herein. In certain embodiments, the strain has at least 95% homology to a strain described herein. In certain embodiments, the strain has at least 50% homology to SEQ ID NO: 51, SEQ ID NO: 52, SEQ ID NO: 53, or SEQ ID NO: 54. In certain embodiments, the strain has at least 60% homology to SEQ ID NO: 51, SEQ ID NO: 52, SEQ ID NO: 53, or SEQ ID NO: 54. In certain embodiments, the strain has at least 70% homology to SEQ ID NO: 51, SEQ ID NO: 52, SEQ ID NO: 53, or SEQ ID NO: 54. In certain embodiments, the strain has at least 80% homology to SEQ ID NO: 51, SEQ ID NO: 52, SEQ ID NO: 53, or SEQ ID NO: 54. In certain embodiments, the strain has at least 90% homology to SEQ ID NO: 51, SEQ ID NO: 52, SEQ ID NO: 53, or SEQ ID NO: 54. In certain embodiments, the strain has at least 95% homology to SEQ ID NO: 51, SEQ ID NO: 52, SEQ ID NO: 53, or SEQ ID NO: 54. In certain embodiments, the strain has at least 99% homology to SEQ ID NO: 51, SEQ ID NO: 52, SEQ ID NO: 53, or SEQ ID NO: 54. In certain embodiments, the strain has 100% homology to SEQ ID NO: 51, SEQ ID NO: 52, SEQ ID NO: 53, or SEQ ID NO: 54.

In certain embodiments, described herein, are methods for treating or preventing acne comprising: administering an effective amount of a metabolite produced by a strain of *P. acnes* to a subject in need thereof. In certain embodiments, the metabolite is selected from the group comprising bacterial culture supernatant, cell lysate, proteins, nucleic acids, lipids, and other bacterial molecules. In certain embodiments, the metabolite is selected from the group comprising bacterial culture supernatant, cell lysate, proteins, nucleic acids, lipids, and other bacterial molecules.

In some embodiments, compositions and methods disclosed herein may comprise use of bacteria that does not comprise *P. acnes* bacteria, or the application thereof, respectively. In some embodiments, the bacteria comprises a *Staphylococcus* strain. In some embodiments, compositions and methods disclosed herein may comprise use of fungus, such as *Malassezia*.

In some embodiments, described herein, methods for treating or preventing acne comprising: administering an effective amount of bacteria associated with healthy or normal skin. Healthy or normal skin may be skin essentially free of acne. In some embodiments, described herein, methods for treating or preventing acne comprising: administering an effective amount of bacteria that produces low to absent levels of pro-inflammatory mediators when co-incubated with a subject's keratinocytes.

In some embodiments, described herein, are methods for treating or preventing acne comprising: administering an effective amount of a bacterium that does not induce expression of RNA that encodes pro-inflammatory proteins. In some embodiments, described herein, methods for treating or preventing acne comprising: administering an effective amount of a bacterium that does not induce expression of pro-inflammatory proteins. In some embodiments, described herein, methods for treating or preventing acne comprising: administering an effective amount of a bacterium that does not induce activity of pro-inflammatory proteins. In some embodiments, described herein, methods for treating or preventing acne comprising: administering an effective amount of a bacterium that does not induce expression of RNA that encodes pro-inflammatory proteins.

In some embodiments, described herein, are methods for treating or preventing acne comprising: administering an effective amount of a bacterium that does not increase expression of RNA that encodes pro-inflammatory proteins. In some embodiments, described herein, are methods for treating or preventing acne comprising: administering an effective amount of a bacterium that does not increase expression of pro-inflammatory proteins. In some embodiments, described herein, methods for treating or preventing acne comprising: administering an effective amount of a bacterium that does not increase activity of pro-inflammatory proteins.

In some embodiments, described herein, are methods for treating or preventing acne comprising: administering an effective amount of a bacterium that does not increase expression of RNA that encodes pro-inflammatory proteins to a level that they would cause or increase acne when the bacterium is applied to a subject. In some embodiments, described herein, are methods for treating or preventing acne comprising: administering an effective amount of a bacterium that does not increase expression of pro-inflammatory proteins to a level that they would cause or increase acne when the bacterium is applied to a subject. In some embodiments, described herein, methods for treating or preventing acne comprising: administering an effective amount of a bacterium that does not increase activity of pro-inflammatory proteins to a level that they would cause or increase acne when the bacterium is applied to a subject. Non-limiting examples of pro-inflammatory proteins include IL-8, IL-1, IL-6, TNF-alpha, INF-alpha, and human beta defensin.

In some embodiments, described herein, are methods for treating or preventing seborrheic dermatitis comprising: administering an effective amount of a health-associated strain of *Propionibacterium* to a subject in need thereof. In some embodiments, described herein, are methods for treating or preventing seborrheic dermatitis comprising: administering an effective amount of a health-associated strain of *P. acnes* to a subject in need thereof. In some embodiments, the methods are performed after the subject has undergone a cosmetic hair treatment (e.g., hair dye). In some embodiments, the effective amount is an amount that results in greater than about 55% *Propionibacterium* on an affected area of the scalp or skin of the subject. In some embodiments, the effective amount is an amount that results in greater than about 60% *Propionibacterium* on an affected area of the scalp or skin of the subject. In some embodiments, the effective amount is an amount that results in greater than about 65% *Propionibacterium* on an affected area of the scalp or skin of the subject. In some embodiments, the effective amount is an amount that results in greater than about 70% *Propionibacterium* on an affected area of the scalp or skin of the subject. In some embodiments, the effective amount is an amount that results between about 55% *Propionibacterium* and about 75% *Propionibacterium* on an affected area of the scalp or skin of the subject. In some embodiments, the effective amount is an amount that results between about 65% *Propionibacterium* and about 80% *Propionibacterium* on an affected area of the scalp or skin of the subject. In some embodiments, the effective amount is an amount that results between about 70% *Propionibacterium* and about 80% *Propionibacterium* on an affected area of the scalp or skin of the subject. In some embodiments, the effective amount is an amount that results between about 70% *Propionibacterium* and about 85% *Propionibacterium* on an affected area of the scalp or skin of the subject. In some embodiments, the effective amount is an amount that provides a desirable ratio of *Propionibacterium* to *Staphylococcus* on the scalp or skin of the subject. The desirable ratio of *Propionibacterium* to *Staphylococcus* may be selected from about 2:1, about 2.5:1, about 3:1, about 3.5:1 and about 4:1. The desirable ratio of *Propionibacterium* to *Staphylococcus* may be selected from at least about 2:1, at least about 2.5:1, at least about 3:1, at least about 3.5:1 and at least about 4:1. The desirable ratio of *Propionibacterium* to *Staphylococcus* may be between about 1.5:1 and about 4:1. The desirable ratio of *Propionibacterium* to *Staphylococcus* may be between about 2:1 and about 4:1. The desirable ratio of *Propionibacterium* to *Staphylococcus* may be between about 2.5:1 and about 4:1. The desirable ratio of *Propionibacterium* to *Staphylococcus* may be between about 3:1 and about 4:1. In some embodiments, an effective amount is an amount that provides a desirable amount of a *Malassezia* fungus.

In some embodiments, the methods of treating disclosed herein further comprise determining strains of bacteria on the skin of the subject that cause or promote inflammation of the skin of the subject. In some embodiments, methods comprise assessing an inflammatory mediated response in a sample of keratinocytes. In some embodiments, methods comprise assessing an inflammatory mediated response in a sample of keratinocytes obtained from a subject. The subject may be a healthy subject. The subject may be a subject to be treated, such as a subject suffering from acne. In some embodiments, the methods comprise pooling or culturing keratinocytes from multiple subjects.

Methods disclosed herein may comprise administering a drug to the subject. In some embodiments, the drug is administered orally. In some embodiments, the drug is administered topically. In some embodiments, the drug is administered topically to the skin of the subject that is affected by acne. In certain embodiments, described herein, are methods for preventing or treating acne in a subject comprising: administering an effective amount of a drug specifically targeting *P. acnes*. In certain embodiments, described herein, are methods for preventing or treating acne in a subject comprising: administering an effective amount of a drug targeting *P. acnes* of a ribotype selected from RT1, RT2, RT3, RT4, RT5, RT7, RT8, RT9, and RT10, and combinations thereof. In certain embodiments, described herein, are methods for preventing or treating acne in a subject comprising: administering an effective amount of a drug targeting *P. acnes* of a ribotype selected from RT1, RT2, RT3, RT7, RT8, RT9, and RT10, and combinations thereof. In certain embodiments, described herein, are methods for preventing or treating acne in a subject comprising: administering an effective amount of a drug targeting a strain of bacteria or fungus that induces or promotes production of inflammatory mediators from a subject's keratinocytes when co-incubated with a subject's keratinocytes. In certain embodiments, described herein, are methods for preventing or treating acne in a subject comprising: administering an effective amount of a drug targeting a strain of bacteria or fungus that induces or promotes production of inflammatory mediators from a subject's keratinocytes when a factor produced by the bacteria or fungus is co-incubated with a subject's keratinocytes. Such drugs are disclosed herein, e.g., small molecules, antisense molecules, siRNA, biologics, antibodies, and combinations thereof.

Methods disclosed herein may comprise performing laser therapy on the skin of the subject. In some embodiments, laser therapy is performed prior to administration of a drug or bacteria disclosed herein to a subject. In some embodiments, laser therapy is performed after administration of a drug or bacteria disclosed herein to a subject. In some embodiments, laser therapy is performed simultaneously with administration of a drug or bacteria disclosed herein to a subject. The laser therapy may be a blue or red-light laser targeting porphyrins.

Compositions disclosed herein may be administered, daily, weekly, or monthly. In certain embodiments, the composition is administered twice daily. In certain embodiments, the composition is administered at least twice weekly. In certain embodiments, the composition is administered at least twice monthly.

Combination Treatments

It is envisioned that the any of the compositions, health-associated microbes or probiotics disclosed herein can be used in combination with other standard treatments. For example, in some embodiments, methods comprise administering compositions disclosed herein before, after, or simultaneously with administration of an additional therapeutic agent. In some embodiments, the methods may comprise topically administering an antibiotic. Non-limiting examples of topical antibiotics include clindamycin, doxycycline, erythromycin, and tetracycline. In some embodiments, the methods may comprise orally administering an antibiotic. Non-limiting examples of oral antibiotics include erythromycin; or a tetracycline, such as doxycycline or minocycline. Other standard treatments may comprise administering an anti-inflammatory agent, an antioxidant, an acid, light therapy, or a combination thereof.

In some embodiments, methods comprise treating the subject with a laser. In some embodiments, methods comprise treating the subject with blue light. In some embodiments, methods comprise treating the subject with red light. In some embodiments, methods comprise treating the subject with a targeted laser device and/or active ingredient directed to at least one pro-inflammatory strain of *P. acnes*. In some embodiments, methods comprise treating with a laser that targets porphyrins.

Treatment of Acne and Other Disorders with Microbiome Transplant

In certain embodiments, described herein, are methods to treat skin disorders comprising administering a microbiome transplant from a healthy donor or a donor unaffected by a disease to a subject in need thereof. In certain embodiments, described herein, are methods to treat skin disorders comprising administering a microbiome transplant from a healthy donor unaffected by a skin disorder. In certain embodiments, the skin disorder is acne. In certain embodiments, the skin disorder is selected from acne, eczema, psoriasis, seborrheic dermatitis, rosacea, autoimmune disease, lichen sclerosis, lichen planus, pruritus, prurigo nodularis, lichen simplex chronicus, and a combination thereof.

In a certain embodiments, the disclosure provides method for obtaining and purifying a microbiome from a stool sample of a healthy individual, wherein the healthy individual is a first subject not suffering from acne or any other skin disorder, and transplanting that to a second subject that suffers from a skin disorder. The skin disorder may be selected from acne, eczema, psoriasis, seborrheic dermatitis, rosacea, autoimmune disease such as lupus, bullous pemphigoid, pemphigus, lichen planus, pruritus, and xerosis. In another embodiment, the disclosure provides a method for obtaining and purifying a microbiome from an oral sample of a healthy individual not suffering from an inflammatory disorder, and transplanting that to a subject that suffers from a skin disorder. Non-limiting examples of inflammatory conditions include autoimmune disease (e.g., vitiligo, pernicious anemia, alopecia areata, pemphigus, pemphigoid, lupus, scleroderma, diabetes), atherosclerosis, and arthritis.

Diagnosis of Acne and Other Diseases

Health-associated *P. acnes* can be differentiated from disease-associated *P. acnes* based on genetic differences. For example, disease-associated *P. acnes* have been shown to harbor genomic elements that encode for multiple virulence genes. Many health-associated *P. acnes*, on the other hand, carry clustered regularly interspaced short palindromic repeat (CRISPR) elements that prevent health-associated *P. acnes* from acquiring virulence genes. In addition to genetic differences, an increase in *P. acnes* derived molecules such as porphyrins, proteases, lipases, and hemolysins, may be associated with disease. Therefore, genes encoding for biosynthesis of *P. acnes* derived molecules (e.g., porphyrins, proteases, lipase, and hemolysins) may be useful to distinguish between health-associated *P. acnes* and disease-associated *P. acnes*.

In one aspect, provided herein are methods of differentiating health-associated *P. acnes* bacteria from disease-associated *P. acnes* bacteria based on genetic markers. Exemplary methods comprise measuring expression of one or more genetic markers including, but not limited to, deoR, Cas5, pIMPLE, type I lipase, type II lipase, and alanine dehydrogenase. In some instances, methods for differentiating between health-associated *P. acnes* and disease-associated *P. acnes* comprise differentiation based on ribotype. Also provided herein are methods of differentiating between health-associated *P. acnes* and disease-associated *P. acnes* comprising quantitative PCR or sequencing of at least one genetic marker, such as, deoR, Cas5, pIMPLE, type I lipase, type II lipase, alanine dehydrogenase, or a combination thereof. In some cases, methods comprise differentiating between strains and/or ribotypes of *P. acnes* bacteria. As a non-limiting example, *P. acnes* RT6 comprises a DNA-binding response regulator and/or phosphoglycerate kinase, which is absent in RT1, RT2, RT3, RT4, and RT5. As another example, an ABC transporter gene is absent from RT6 and present in RT1, RT2, RT3, RT4, and RT5. In some cases, such methods are used to select for bacteria for use in a probiotic described herein. For example, RT6 is not present in a probiotic. In some cases, such methods are used to monitor treatment of an individual with the probiotic. Moreover, in some cases, the methods are used to distinguish between a health-associated and disease-associated bacteria of the same ribotype. For example, *P. acnes* RT1 has both a disease-associated and health-associated *P. acnes* that are distinguishable based on the presence and/or absence of genetic markers.

Methods of diagnosing and/or monitoring treatment of a disease in an individual comprising quantifying health-associated and/or disease-associated *P. acnes* in a sample from the individual are also provided. Certain methods for quantification as provided herein comprise measuring at least one of deoR, a CRISPR-associated protein, pIMPLE, type I lipase, type II lipase, alanine dehydrogenase, DNA-binding response regulator, phosphoglycerate kinase, and ABC transporter. 23 S ribosomal RNA may be measured to determine quantity of total bacteria in a sample. In some embodiments, the treatment comprises administration of a health-associated microbe or probiotic provided herein. As a non-limiting example, the probiotic comprises a *P. acnes* of RT1 and RT2. In some cases, the probiotic does not comprise a *P. acnes* of RT6.

Further provided herein are methods for determining a microbiome profile in an individual by detecting and/or quantifying at least one of deoR, a CRISPR-associated protein, pIMPLE, type I lipase, type II lipase, alanine dehydrogenase, DNA-binding response regulator, phosphoglycerate kinase, and ABC transporter in a sample from the individual. For determining relative quantities of bacteria in a sample, 23S ribosomal RNA sequences may be used to estimate total bacteria in a sample from the individual. Determination of a microbiome profile may be useful before and/or during treatment, for example, treatment with a probiotic or health-associated bacteria, such as *P. acnes*. Methods for monitoring a treatment regimen following determination of a microbiome profile are also provided.

Further provided are methods of diagnosing or characterizing acne or other skin disorders in an individual. Such methods may be combined with the probiotics and bacterial compositions provided herein to assess for suitability for treatment and/or treatment monitoring. In certain embodiments, the disease is acne. In certain embodiments, the skin disorder is acne, eczema, psoriasis, seborrheic dermatitis, rosacea, autoimmune disease, lichen sclerosis, lichen planus, pruritus, prurigo nodularis, lichen simplex chronicus, or a combination thereof. In certain embodiments, an individual is diagnosed with acne if the individual is determined to possess a pathogenic strain of *Propionibacterium acnes* (*P. acnes*), *Staphylococcus*, or *Malassezia* fungi. In certain embodiments, the pathogenic strain of *P. acnes* comprises a ribotype (RT) that is associated with acne. In certain embodiments, the acne associated strain of *P. acnes* is of a ribotype selected from RT1, RT 4, RT5, RT7, RT8, RT9, and RT10. In certain embodiments, the acne associated strain of *P. acnes* is of a ribotype selected from RT 4, RT5, and RT8. In certain embodiments, the methods comprise diagnosing the individual with acne if a presence of *Staphylococcus* bacteria is detected in a sample of the subject. In certain embodiments, the methods comprise diagnosing the individual with acne if a presence of *Malassezia* fungi is detected in a sample of the subject.

In certain embodiments, the disclosure provides a method comprising: obtaining a skin sample from a subject; optionally isolating bacterial DNA from the sample; using one or more primer sets to amplify the DNA; and analyzing the amplified DNA for the presence of a sequence having at least 95% homology with at least one of SEQ ID NOs 1-10, 29-32 and 82-434, wherein the subject is diagnosed as having acne if the presence of a sequence having at least 95% homology with at least one of SEQ ID NOs 1-10, 29-32 and 82-434 exists. For example, the amplified DNA may be analyzed for the presence of a sequence having at least 99% homology with at least one of SEQ ID NOs 1-10, 29-32 and 82-434 and wherein the subject is diagnosed as having acne if the presence of a sequence having at least 99% homology with at least one of SEQ ID NOs 1-10, 29-32 and 82-434 exists. As another example, the amplified DNA may be analyzed for the presence of at least one of SEQ ID NOs 1-10, 29-32 and 82-434 and wherein the subject is diagnosed as having acne if the presence of at least one of SEQ ID NOs 1-10, 29-32 and 82-434 exists.

In certain embodiments, methods comprise detecting or characterizing a microbe in a sample of a subject. In some embodiments, the methods comprise detecting the microbe in an ex vivo sample. In some embodiments, the methods comprise detecting the microbe in an in vivo sample. An exemplary method comprises: obtaining a stool sample from the subject; isolating bacterial DNA from the sample; amplifying DNA selected from 16S, ribosomal DNA, 18S ribosomal DNA, and/or 23S ribosomal DNA, sequencing the amplified DNA products; and typing the individual's gut bacteria. In certain embodiments, are methods for determining whether a subject has acne comprising: obtaining a stool sample from the subject; isolating bacterial DNA from the sample and whole genome shotgun sequencing DNA in the sample. Another exemplary method comprises obtaining a swab of skin sample from the subject, such as from the face, back or other affected area.

Biological Samples for Diagnosis

In certain embodiments, diagnosing an individual comprises obtaining a biological sample. In certain embodiments, the biological sample is a skin sample or biopsy. In certain embodiments, the biological sample is a stool or fecal sample. In certain embodiments, the biological sample is an oral or oral mucosal sample. In certain embodiments, the biological sample is a swab, obtained using a cotton swab or other compatible swab. In certain embodiments, the sample contains bacteria. In certain embodiments, the sample contains a fungus. In certain embodiments, the sample contains a virus. In certain embodiments, the virus is a bacteriophage. In certain embodiments, the sample is stored after it has been collected, but before additional steps are performed. In certain embodiments, storage occurs at less than 8° C. In certain embodiments, storage occurs at less than 4° C. In certain embodiments, storage occurs at less than 0° C. In certain embodiments, storage occurs at less than −20° C. In certain embodiments, storage occurs at less than −70° C. In certain embodiments, this storage is in glycerol, glycol, dimethyl sulfoxide, growth media, nutrient broth or any combination thereof. In certain embodiments, the sample is stored for at least about 1, 2, 3, 4, 5, 6, or 7 days. In some embodiments, the sample is stored for at least about 1, 2, 3, or 4 weeks. In some embodiments, the sample is stored for at least about 1, 2, 3, 4, 5, 6, 7, 8, 9, 10, 11 or 12 months. In some embodiments, the sample is stored for up to about 1, 2, 3, or 4 weeks. In some embodiments, the sample is stored for up to about 1, 2, 3, 4, 5, 6, 7, 8, 9, 10, 11 or 12 months.

In some embodiments, a composition disclosed herein is stable at room temperature (~25° C.) for at least about one day. In some embodiments, a composition disclosed herein is stable for at least about three days. In some embodiments, a composition disclosed herein is stable for at least about six days. In some embodiments, a composition disclosed herein is stable for at least about nine days. In some embodiments, a composition disclosed herein is stable for at least about twelve days.

In some embodiments, compositions disclosed herein possess therapeutic activity when applied to skin with a skin disorder. In some embodiments, compositions disclosed herein possess an initial therapeutic activity at the time the composition is produced or packaged. In some embodiments, a composition disclosed herein maintains its initial therapeutic activity at room temperature (~25° C.) for at least about one day. In some embodiments, a composition disclosed herein maintains its initial therapeutic activity for at least about three days. In some embodiments, a composition disclosed herein maintains its initial therapeutic activity for at least about six days. In some embodiments, a composition disclosed herein maintains its initial therapeutic activity for at least about nine days. In some embodiments, a composition disclosed herein maintains its initial therapeutic activity for at least about twelve days.

In some embodiments, a composition disclosed herein maintains at least about 90% of its initial therapeutic activity at room temperature (~25° C.) for at least about one day. In some embodiments, a composition disclosed herein maintains at least about 90% of its initial therapeutic activity for at least about three days. In some embodiments, a composition disclosed herein maintains at least about 90% of its initial therapeutic activity for at least about six days. In some embodiments, a composition disclosed herein maintains at least about 90% of its initial therapeutic activity for at least about nine days. In some embodiments, a composition disclosed herein maintains at least about 90% of its initial therapeutic activity for at least about twelve days.

In some embodiments, a composition disclosed herein maintains at least about 80% of its initial therapeutic activity at room temperature (~25° C.) for at least about one day. In some embodiments, a composition disclosed herein maintains at least about 80% of its initial therapeutic activity for at least about three days. In some embodiments, a composition disclosed herein maintains at least about 80% of its initial therapeutic activity for at least about six days. In some embodiments, a composition disclosed herein maintains at least about 80% of its initial therapeutic activity for at least about nine days. In some embodiments, a composition disclosed herein maintains at least about 80% of its initial therapeutic activity for at least about twelve days.

In some embodiments, a composition disclosed herein maintains at least about 70% of its initial therapeutic activity at room temperature (~25° C.) for at least about one day. In some embodiments, a composition disclosed herein maintains at least about 70% of its initial therapeutic activity for at least about three days. In some embodiments, a composition disclosed herein maintains at least about 70% of its initial therapeutic activity for at least about six days. In some embodiments, a composition disclosed herein maintains at least about 70% of its initial therapeutic activity for at least about nine days. In some embodiments, a composition disclosed herein maintains at least about 70% of its initial therapeutic activity for at least about twelve days.

In some embodiments, a composition disclosed herein maintains at least about 50% of its initial therapeutic activity at room temperature (~25° C.) for at least about one day. In some embodiments, a composition disclosed herein maintains at least about 50% of its initial therapeutic activity for at least about three days. In some embodiments, a composition disclosed herein maintains at least about 50% of its initial therapeutic activity for at least about six days. In some embodiments, a composition disclosed herein maintains at least about 50% of its initial therapeutic activity for at least about nine days. In some embodiments, a composition disclosed herein maintains at least about 50% of its initial therapeutic activity for at least about twelve days.

In some embodiments, the sample is cultured at a physiological temperature suitable for bacterial growth such as 30° C., 31° C., 32° C., 33° C., 34° C., 35° C., 36° C., 37° C., 38° C., 39° C. or 40° C. In some embodiments, the sample is cultured at about 35° C. to about 39° C. In some embodiments, the sample is cultured at about 36° C. to about 38° C. In some embodiments, the sample is cultured in a liquid growth media. In some embodiments, the sample is cultured on a solid growth media such as an agar plate. In some embodiments, the plates are blood agar.

In certain embodiments, samples disclosed herein are processed further before analysis. In some embodiments, no extraction or processing procedures are performed on the sample. In some embodiments, nucleic acid is extracted from the sample. In some embodiments, the nucleic acid is DNA. In some embodiments, the DNA is bacterial DNA. In some embodiments, the Bacterial DNA is 16S ribosomal DNA. In some embodiments, the Bacterial DNA is 18S ribosomal DNA. In some embodiments, the Bacterial DNA is 23S ribosomal DNA. In some embodiments, the nucleic acid is ribosomal DNA. In some embodiments, the nucleic acid is RNA. In some embodiments, the nucleic acid is ribosomal RNA. In certain embodiments, the nucleic acid is extracted using any technique that does not interfere with subsequent analysis. In certain embodiments, this technique uses alcohol precipitation using ethanol, methanol or isopropyl alcohol. In certain embodiments, this technique uses phenol, chloroform, or any combination thereof. In certain embodiments, this technique uses cesium chloride. In certain embodiments, this technique uses sodium, potassium or ammonium acetate or any other salt commonly used to precipitate DNA. In certain embodiments, this technique utilizes a column or resin based nucleic acid purification scheme such as those commonly sold commercially, one non-limiting example would be the GenElute Bacterial Genomic DNA Kit available from Sigma Aldrich. In certain embodiments, after extraction the nucleic acid is stored in water, Tris buffer, or Tris-EDTA buffer before subsequent analysis. In certain embodiments, this storage is less than 8° C. In certain embodiments, this storage is less than 4° C. In certain embodiments, this storage is less than 0° C. In certain embodiments, this storage is less than −20° C. In certain embodiments, this storage is less than −70° C. In certain embodiments, the nucleic acid is stored for 1, 2, 3, 4, 5, 6, or 7 days. In some embodiments, the nucleic acid is stored for 1, 2, 3, or 4 weeks. In some embodiments, the nucleic acid is stored for 1, 2, 3, 4, 5, 6, 7, 8, 9, 10, 11 or 12 months.

After the samples have been obtained and the relevant nucleic acids isolated the nucleic acids are sequenced. In certain embodiments, the nucleic acid sequenced is bacterial DNA. In certain embodiments, the nucleic acid sequence is bacterial 16S ribosomal DNA. In certain embodiments, the nucleic acid sequence is bacterial 18S ribosomal DNA. In certain embodiments, the nucleic acid sequence is bacterial 23S ribosomal DNA. In certain embodiments, the nucleic acid sequenced is bacteriophage DNA. In certain embodiments, the sequence is determined using PCR. In certain embodiments, at least one primer used in the PCR has a sequence that corresponds to SEQ ID NO: 11, SEQ ID NO: 12, SEQ ID NO: 13, SEQ ID NO: 14, SEQ ID NO: 15, SEQ ID NO: 16, SEQ ID NO: 17, SEQ ID NO: 18, SEQ ID NO: 19, SEQ ID NO: 20, SEQ ID NO: 21, SEQ ID NO: 22, SEQ ID NO: 23, SEQ ID NO: 24, SEQ ID NO: 25, SEQ ID NO: 26, SEQ ID NO: 27 or SEQ ID NO: 28. In certain embodiments, the PCR used is quantitative. In certain embodiments, the PCR reaction utilizes a Taqman™ or a similar quantitative PCR technology. In certain embodiments, the sequencing is performed using the Sanger sequencing method. In certain embodiments, the sequencing involves the use of chain terminating dideoxynucleotides. In certain embodiments, the sequencing involves gel-electrophoresis. In certain embodiments, the sequencing is performed using a next generation sequencing method. In certain embodiments, the method is pyrosequencing. In certain embodiments, the method is ion semiconductor sequencing. In certain embodiments, the method is sequencing by synthesis. In certain embodiments, the method is sequencing by ligation. In certain embodiments, the method is single molecule real time sequencing.

After the nucleic acids are sequenced, in certain embodiments, described herein diagnosis is made. In certain, embodiments, diagnosis requires the use of a computer, statistical analysis, statistical analysis software, sequence analysis software, or any combination thereof. In certain embodiments, different organisms are identified. In certain embodiments, *Malassezia* fungi are identified. In certain embodiments, different strains of bacteria are identified during compiling of the microbiome. In certain embodiments, *Staphylococcus* bacteria are identified. In certain embodiments, different strains of *P. acnes* are identified during compiling of the microbiome. In certain embodiments, different strains of *P. acnes* are identified based upon their 16S ribosomal sequence or ribotype. In certain embodiments, *P. acnes* are identified as belonging to RT1-RT10. In certain embodiments, the *P. acnes* are identified as belonging to RT1, RT2, RT3, RT6, or any combination thereof. In further embodiments, a diagnostic report may be sent through or accessed by the internet. A diagnostic report may be sent through the mail to a health care provider, physician, or patient.

In certain embodiments, this disclosure provides a method for determining the presence of antibiotic resistant bacteria in an individual with acne comprising, obtaining a skin sample from an individual, isolating bacterial DNA from the sample, amplifying the relevant regions of the 16S, 18S or 23S ribosomal RNA from the sample, sequencing the amplified DNA products and determining antibiotic resistance to tetracycline and erythromycin/clindamycin classes of antibiotics respectively. In certain embodiments, bacteria present on or isolated from an individual's skin is tested or determined to be resistant to antibiotics. In certain embodiments, the antibiotic is erythromycin. In certain embodiments, the antibiotic is clindamycin. In certain embodiments, antibiotic resistance is determined from the sequence of the 16S, 18S or 23S ribosomal subtype.

Methods of Preserving Preparations of *Propionibacterium*

Provided herein, in some aspects, are methods of producing desired preparations of *Propionibacterium*. In some embodiments, the methods comprise producing a desired preparation of at least one strain of *Propionibacterium*. In some embodiments, the at least one strain is a strain of *P. acnes*. In some embodiments, the at least one strain is not a strain of *P. acnes* subsp. *acnes*. In some embodiments, the at least one strain is a strain of *P. avidum*. In some embodiments, the at least one strain is a strain of *P. granulosum*. In some embodiments, the at least one strain is a strain of *P. acnes* subsp. *defendens*. In preferred embodiments, the strain of *Propionibacterium* is a health-associated strain, as described herein.

In some embodiments, methods comprise adding a sample of the *Propionibacterium* to a glycerol solution to produce a *Propionibacterium* glycerol stock, and storing the *Propionibacterium* glycerol stock at a temperature of about 4° C. or less. Producing a desired preparation of *Propionibacterium* may comprise at least one of cooling, freezing, and storing a *Propionibacterium* sample, a composition thereof or a stock thereof.

By way of non-limiting example, methods are provided herein for producing a desired preparation of a *P. acnes* bacteria comprising adding a sample of the *Propionibacterium* to a glycerol solution to produce a *Propionibacterium* glycerol stock, and storing the *Propionibacterium* glycerol stock at a temperature of about 4° C. or less, wherein more than about 50% of the *Propionibacterium* bacteria is viable when the *Propionibacterium* in the glycerol solution is brought to ambient temperature.

Also by way of non-limited examples, methods are provided herein for producing a desired preparation of preserved *Propionibacterium*, wherein about 90% of said *Propionibacterium* is viable after sixty days of storage, said method comprising: adding a sample of *Propionibacterium* to a solution of about 50% glycerol to produce a *Propionibacterium* stock, freezing the *Propionibacterium* glycerol stock at −20° C., thereby forming said desired preparation wherein greater than about 90% of the sample of *Propionibacterium* are viable after a thawing of the *Propionibacterium* glycerol stock.

In some embodiments, methods comprise storing the *Propionibacterium*, wherein at least about 1% of the *Propionibacterium* is viable when the *Propionibacterium* in the glycerol solution is brought to ambient temperature. In some embodiments, methods comprise storing the *Propionibacterium*, wherein at least about 5% of the *Propionibacterium* is viable when the *Propionibacterium* in the glycerol solution is brought to ambient temperature. In some embodiments, methods comprise storing the *Propionibacterium*, wherein at least about 10% of the *Propionibacterium* is viable when the *Propionibacterium* in the glycerol solution is brought to ambient temperature. In some embodiments, methods comprise storing the *Propionibacterium*, wherein at least about 15% of the *Propionibacterium* is viable when the *Propionibacterium* in the glycerol solution is brought to ambient temperature. In some embodiments, methods comprise storing the *Propionibacterium*, wherein at least about 20% of the *Propionibacterium* is viable when the *Propionibacterium* in the glycerol solution is brought to ambient temperature. In some embodiments, methods comprise storing the *Propionibacterium*, wherein at least about 30% of the *Propionibacterium* is viable when the *Propionibacterium* in the glycerol solution is brought to ambient temperature. In some embodiments, methods comprise storing the *Propionibacterium*, wherein at least about 40% of the *Propionibacterium* is viable when the *Propionibacterium* in the glycerol solution is brought to ambient temperature. In some embodiments, methods comprise storing the *Propionibacterium*, wherein at least about 50% of the *Propionibacterium* is viable when the *Propionibacterium* in the glycerol solution is brought to ambient temperature. In some embodiments, at least about 60% of the *Propionibacterium* is viable when the *Propionibacterium* in the glycerol solution is brought to ambient temperature. In some embodiments, at least about 70% of the *Propionibacterium* is viable when the *Propionibacterium* in the glycerol solution is brought to ambient temperature. In some embodiments, at least about 80% of the *P. acnes* bacteria is viable when the *Propionibacterium* in the glycerol solution is brought to ambient temperature. In some embodiments, more than about 90% of the *Propionibacterium* are viable when the *Propionibacterium* in the glycerol solution is brought to ambient temperature.

In some embodiments, methods comprise adding the *Propionibacterium* to a glycerol solution, wherein the glycerol solution is between about 5% and about 75% glycerol. In some embodiments, methods comprise adding the *Propionibacterium* to a glycerol solution, wherein the glycerol solution is between about 5% and about 65% glycerol. In some embodiments, methods comprise adding the *Propionibacterium* to a glycerol solution, wherein the glycerol solution is between about 5% and about 55% glycerol. In some embodiments, methods comprise adding the *Propionibacterium* to a glycerol solution, wherein the glycerol solution is between about 5% and about 45% glycerol. In some embodiments, methods comprise adding the *Propionibacterium* to a glycerol solution, wherein the glycerol solution is between about 5% and about 35% glycerol. In some embodiments, methods comprise adding the *Propionibacterium* to a glycerol solution, wherein the glycerol solution is between about 5% and about 25% glycerol. In some embodiments, methods comprise adding the *Propionibacterium* to a glycerol solution, wherein the glycerol solution is between about 25% and about 75% glycerol. In some embodiments, the glycerol solution is between about 30% and about 70% glycerol. In some embodiments, the glycerol solution is between about 35% and about 65% glycerol. In some embodiments, the glycerol solution is between about 40% and about 60% glycerol. In some embodiments, the glycerol solution is between about 45% and about 50% glycerol. In some embodiments, the glycerol solution is about 25% glycerol. In some embodiments, the glycerol solution is about 30% glycerol. In some embodiments, the glycerol solution is about 35% glycerol. In some embodiments, the glycerol solution is about 40% glycerol. In some embodiments, the glycerol solution is about 45% glycerol. In some embodiments, the glycerol solution is about 50% glycerol. In some embodiments, the glycerol solution is about 55% glycerol. In some embodiments, the glycerol solution is about 60% glycerol.

In some embodiments, methods comprise storing *Propionibacterium*, or a composition thereof, disclosed herein, at a selected temperature. In some embodiments, methods comprise storing the *Propionibacterium* glycerol stock at a selected temperature. In some embodiments, the temperature is between about 30° C. and about −80° C. In some embodiments, the temperature is between about 25° C. and about −80° C. In some embodiments, the temperature is between about 25° C. and about −20° C. In some embodiments, the temperature is between about 30° C. and about 4° C. In some embodiments, the temperature is between about 10° C. and about −80° C. In some embodiments, the temperature is between about 10° C. and about −40° C. In some embodiments, the temperature is between about 10° C. and about −30° C. In some embodiments, the temperature is between about 10° C. and about −20° C. In some embodiments, the temperature is between about 4° C. and about −80° C. In some embodiments, the temperature is between about 4° C. and about −25° C. In some embodiments, the temperature is between about 4° C. and about −20° C. In some embodiments, the temperature is about 22° C. to about 28° C. In some embodiments, the temperature is about 25° C. In some embodiments, the temperature is about 4° C. In some embodiments, the temperature is about −20° C. In some embodiments, the temperature is between about −80° C.

In some embodiments, methods comprise thawing a composition of *Propionibacterium* disclosed herein. In some embodiments, methods comprise warming a composition of *Propionibacterium* bacteria disclosed herein. In some embodiments, methods comprise thawing a *Propionibacterium* glycerol stock at room temperature. In some embodiments, methods comprise rapid thawing the *Propionibacterium* glycerol stock in a bath. The bath temperature may be between about 25° C. and about 40° C. In some embodiments, methods comprise rapidly thawing a composition of *Propionibacterium* bacteria disclosed herein. By way of non-limiting example, a subject may apply a composition disclosed herein, wherein the composition is frozen, directly to skin. In some embodiments, methods comprise slowly thawing a composition of *Propionibacterium* bacteria disclosed herein. By way of non-limiting example, a subject may transfer a composition disclosed herein that is frozen to a refrigerator to reach a refrigerated temperature before being brought to room temperature, before being applied to skin, or before being combined with another composition (e.g., emollient, lotion, gel). The term "frozen" includes compositions at temperatures at which the composition is in a solid form or semi-solid form. Frozen may include compositions at temperatures of less than 0° C., and less than −15° C. The term "refrigerated temperature" refers to a temperature of about 0° C. to about 10° C., e.g., 4° C. A refrigerated temperature does not necessarily need to be achieved with a refrigerator. By non-limiting example, an ice bucket could similarly cool a sample.

In some embodiments, methods comprise storing a *Propionibacterium* glycerol stock, wherein at least about 60% to at least about 90% of the *Propionibacterium* sample is viable after the *Propionibacterium* glycerol stock is brought to ambient temperature. In some embodiments, the at least about 70% to at least about 90% of the *P. acnes* sample is viable after the *Propionibacterium* glycerol stock is brought to ambient temperature. In some embodiments, the at least about 80% to at least about 90% of the viable after the *Propionibacterium* glycerol stock is brought to ambient temperature. In some embodiments, at least about 60% of *Propionibacterium* sample is viable after the *Propionibacterium* glycerol stock is brought to ambient temperature. In some embodiments, at least about 70% of the *P. acnes* sample is viable after the *Propionibacterium* glycerol stock is brought to ambient temperature. In some embodiments, at least about 80% of the *Propionibacterium* sample is viable after the *Propionibacterium* glycerol stock is brought to ambient temperature. In some embodiments, at least about 90% of the *P. acnes* sample is viable after the *Propionibacterium* glycerol stock is brought to ambient temperature. Ambient temperature is considered an acceptable room temperature. In some embodiments, the ambient temperature is between about 25° C. and about 35° C. In some embodiments, the ambient temperature is between about 20° C. and about 30° C. In some embodiments, the ambient temperature is between about 22° C. and about 28° C. In some embodiments, the ambient temperature is about 25° C.

In some embodiments, methods comprise storing a *Propionibacterium* glycerol stock, wherein at least about 50% of the *Propionibacterium* sample is viable after at least about 30 days of storing. In some embodiments, at least about 60% of the *Propionibacterium* sample is viable after at least about 30 days of storing. In some embodiments, at least about 70% of the *Propionibacterium* sample is viable after at least about 20 days of storing. In some embodiments, at least about 80% of the *Propionibacterium* sample is viable after at least about 30 days of storing. In some embodiments, at least about 90% of the *Propionibacterium* sample is viable after at least about 30 days of storing. In some embodiments, at least about 95% of the *Propionibacterium* sample is viable after at least about 30 days of storing. In some embodiments, at least about 50% of the *Propionibacterium* sample is viable after at least about 60 days of storing. In some embodiments, at least about 60% of the *Propionibacterium* sample is viable after at least about 60 days of storing. In some embodiments, at least about 70% of the *P. acnes* sample is viable after at least about 60 days of storing. In some embodiments, at least about 80% of the *Propionibacterium* sample is viable after at least about 60 days of storing. In some embodiments, at least about 90% of the *Propionibacterium* sample is viable after at least about 60 days of storing. In some embodiments, at least about 95% of the *Propionibacterium* sample is viable after at least about 60 days of storing. In some embodiments, at least about 50% of the *Propionibacterium* sample is viable after at least about 90 days of storing. In some embodiments, at least about 60% of the *Propionibacterium* sample is viable after at least about 90 days of storing. In some embodiments, at least about 70% of the *Propionibacterium* sample is viable after at least about 90 days of storing. In some embodiments, at least about 80% of the *Propionibacterium* sample is viable after at least about 90 days of storing. In some embodiments, at least about 90% of the *Propionibacterium* sample is viable after at least about 90 days of storing. In some embodiments, at least about 95% of the *Propionibacterium* sample is viable after at least about 90 days of storing. In some embodiments, at least about 50% of the *Propionibacterium* sample is viable after at least about 120 days of storing. In some embodiments, at least about 60% of the *Propionibacterium* sample is viable after at least about 120 days of storing. In some embodiments, at least about 70% of the *Propionibacterium* sample is viable after at least about 120 days of storing. In some embodiments, at least about 80% of the *Propionibacterium* sample is viable after at least about 120 days of storing. In some embodiments, at least about 90% of the *Propionibacterium* sample is viable after at least about 120 days of storing. In some embodiments, at least about 95% of the *Propionibacterium* sample is viable after at least about 120 days of storing. In some embodiments, at least about 50% of the *Propionibacterium* sample is viable after at least about 180 days of storing. In some embodiments, at least about 60% of the *Propionibacterium* sample is viable after at least about 180 days of storing. In some embodiments, at least about 70% of the sample is viable after at least about 180 days of storing. In some embodiments, at least about 80% of the *Propionibacterium* sample is viable after at least about 180 days of storing. In some embodiments, at least about 90% of the *Propionibacterium* sample is viable after at least about 180 days of storing. In some embodiments, at least about 95% of the *Propionibacterium* sample is viable after at least about 180 days of storing. In some embodiments, at least about 50% of the *Propionibacterium* sample is viable after at least about a year of storing. In some embodiments, at least about 60% of the *Propionibacterium* sample is viable after at least about a year of storing. In some embodiments, at least about 70% of the *Propionibacterium* sample is viable after at least about a year of storing. In some embodiments, at least about 80% of the *Propionibacterium* sample is viable after at least about a year of storing. In some embodiments, at least about 90% of the *Propionibacterium* sample is viable after at least about a year of storing. In some embodiments, at least about 95% of the *Propionibacterium* sample is viable after at least about a year of storing.

In some embodiments, methods comprise storing *Propionibacterium* in a solution, wherein the solution is between about 10% glycerol v/v and about 90% glycerol v/v in solution. In some embodiments, the solution is between about 20% glycerol v/v and about 80% glycerol v/v in solution. In some embodiments, the solution is between about 25% glycerol v/v and about 75% glycerol v/v in solution. In some embodiments, the solution is between about 30% glycerol v/v and about 70% glycerol v/v in solution. In some embodiments, the solution is between about 35% glycerol v/v and about 65% glycerol v/v in solution. In some embodiments, the solution is between about 40% glycerol v/v and about 60% glycerol v/v in solution. In some embodiments, the solution is between about 45% glycerol v/v and about 55% glycerol v/v in solution. In some embodiments, the solution is between about 15% glycerol v/v and about 35% glycerol v/v in solution. In some embodiments, the solution is between about 20% glycerol v/v and about 30% glycerol v/v in solution. In some embodiments, the solution is about 20% glycerol v/v in solution. In some embodiments, the solution is about 25% glycerol v/v in solution. In some embodiments, the solution is about 30% glycerol v/v in solution. In some embodiments, the solution is about 35% glycerol v/v in solution. In some embodiments, the solution is about 40% glycerol v/v in solution. In some embodiments, the solution is about 45% glycerol v/v in solution. In some embodiments, the solution is about 50% glycerol v/v in solution. In some embodiments, the solution is about 50% glycerol v/v in solution. In some embodiments, the solution is about 55% glycerol v/v in solution. In some embodiments, the solution is about 60% glycerol v/v in solution. In some embodiments, the solution is about 65% glycerol v/v in solution. In some embodiments, the solution is about 75% glycerol v/v in solution.

In some embodiments, methods comprise storing *Propionibacterium* bacteria in a solution, wherein the solution comprises glycerol and water. In some embodiments, the solution consists essentially of glycerol and water. In some embodiments, methods comprise storing *Propionibacterium* in a solution, wherein the solution comprises glycerol and a saline solution. In some embodiments, the solution consists essentially of glycerol and a saline solution. In some embodiments, the solution comprises glycerol and a buffered saline solution. In some embodiments, the solution consists essentially of glycerol and a buffered saline solution. In some embodiments, the solution comprises glycerol and a buffered solution. In some embodiments, the buffered solution comprises sodium bicarbonate, citric acid or triethanolamine. In some embodiments, the solution comprises glycerol and a phosphate buffered saline solution. In some embodiments, the solution consists essentially of glycerol and a phosphate buffered saline solution.

In some embodiments, methods comprise storing *Propionibacterium* in a solution, wherein the solution has a pH of between about 3.5 and about 7. In some embodiments, the solution has a pH of between about 4 and about 6.5. In some embodiments, the solution has a pH of between about 4 and about 6. In some embodiments, the solution has a pH of between about 4 and about 5.5. In some embodiments, the solution has a pH of between about 4.5 and about 5.5. In some embodiments, the solution has a pH of between about 4.8 and about 5. In some embodiments, the solution has a pH of about 4. In some embodiments, the solution has a pH of about 4.2. In some embodiments, the solution has a pH of about 4.4. In some embodiments, the solution has a pH of about 4.6. In some embodiments, the solution has a pH of about 4.8. In some embodiments, the solution has a pH of about 5. In some embodiments, the solution has a pH of about 5.2. In some embodiments, the solution has a pH of about 5.4. In some embodiments, the solution has a pH of about 5.6. In some embodiments, the solution has a pH of about 5.8. In some embodiments, the solution has a pH of about 6.

In some embodiments, methods comprise storing *Propionibacterium* in a solution, wherein the solution comprises a salt or ion thereof. In some embodiments, the solution comprises an ion selected from potassium, calcium, magnesium, sodium, and boron. In some embodiments, the solution comprises potassium. In some embodiments, the solution comprises potassium. In some embodiments, the concentration of the salt or ion thereof is between about 0.001 mM and about 1 mM. In some embodiments, the concentration of the salt or ion thereof is between about 0.001 mM and about 0.1 mM. In some embodiments, the concentration of the salt or ion thereof is between about 0.01 mM and about 0.1 mM. In some embodiments, the concentration of the salt or ion thereof is between about 0.05 mM and about 0.1 mM. In some embodiments, the concentration of the salt or ion thereof is between about 0.01 mM and about 1 mM. In some embodiments, the concentration of the salt or ion thereof is between about 0.1 mM and about 1 mM. In some embodiments, the concentration of the salt or ion thereof is between about 100 mM and about 250 mM. In some embodiments, the concentration of the salt or ion thereof is between about 125 mM and about 225 mM. In some embodiments, the concentration of the salt or ion thereof is between about 150 mM and about 200 mM. In some embodiments, the concentration of potassium is between about 100 mM and about 250 mM. In some embodiments, the concentration of potassium is between about 125 mM and about 225 mM. In some embodiments, the concentration of potassium is between about 150 mM and about 200 mM. In some embodiments, the solution comprises calcium at a concentration of about 0.001 mM to about 1 mM. In some embodiments, the solution comprises calcium at a concentration of about 0.01 mM to about 0.5 mM. In some embodiments, the solution comprises calcium at a concentration of about 0.05 mM to about 0.1 mM.

In some embodiments, methods comprise storing *Propionibacterium* in a solution, wherein the solution comprises a prebiotic stabilizing agent. In some embodiments, the prebiotic stabilizing agent is selected from a polysaccharide or oligosaccharide. In some embodiments, the prebiotic stabilizing agent is inulin. In some embodiments, the stabilizing agent is present in the solution at a concentration of about 0.01% v/v to about 1% v/v. In some embodiments, the stabilizing agent is present in the solution at a concentration of about 0.01% v/v to about 0.5% v/v. In some embodiments, the stabilizing agent is present in the solution at a concentration of about 0.05% v/v to about 0.2% v/v. In some embodiments, the solution comprises inulin at a concentration of about 0.01% v/v to about 1% v/v. In some embodiments, the solution comprises inulin at a concentration of about 0.01% v/v to about 0.5% v/v. In some embodiments, the solution comprises inulin at a concentration of about 0.05% v/v to about 0.2% v/v. For clarity, the term % v/v, as used herein, represent the percentage of a total volume of a solution that is represented by a volume of a component of the solution.

In some embodiments, methods comprise storing *Propionibacterium* in a solution, wherein the solution comprises an anti-acne agent, wherein the anti-acne agent is an agent that prevents, reduces or abolishes acne. In some embodiments, the anti-acne agent is selected from a retinoid, a vitamin, an antioxidant, a peroxide, an acid, an oil, an alcohol, an extract, and analogs thereof. For clarity, the term, "analog," as used herein, refers to a compound having a structure similar to that of another one, but differing from it by less than about 10% of the total structure. In some embodiments, the retinoid is selected from tretinoin, tazarotene, adapalene, and retinol. In some embodiments, the vitamin or analog thereof is selected from a Vitamin A, Vitamin C, Vitamin D, Vitamin E, and calciptotriene. In some embodiments, the antioxidant is selected from Vitamin C and Vitamin E. peroxide is benzoyl peroxide. In some embodiments, the acid is selected from salicylic acid, azaelic acid, trichloracetic acid, and glycolic acid. In some embodiments, the alcohol is selected from cetyl alcohol, stearyl alcohol, and cetearyl alcohol. In some embodiments, the alcohol is selected from retinol (also known as Vitamin $A_1$) and resveratrol. In some embodiments, the oil is selected from lavender oil, clary sage oil, juniper berry oil, bergamot oil, jojoba oil, rosemary oil, coconut oil, avocado oil, peppermint oil, and tea tree oil. In some embodiments, the oil is tea tree oil. In some embodiments, the extract is selected from an extract of aloe, garlic, amaranth, neem, coriander, lemon, basil, grapefruit, cucumber, grape, beet, green tea or a combination thereof. In some embodiments, the extract is a green tea extract.

In some embodiments, methods comprise storing *Propionibacterium* in a solution, wherein the solution is incorporated in a biologic stability platform. In some embodiments, the biologic stability platform eliminates a need for temperature control, e.g., cold chain storage. In some embodiments, the biologic storage platform comprises foam drying or foam formation of the solution or glycerol stock solution. In some embodiments, the biologic stability platform comprises at least one of a glyconanoparticle, a liposome, a nanoparticle, trehalose, sucrose, stachyose, hydroxyethyl starch, and a combination of glycine and mannitol.

In some embodiments, methods comprise storing or preserving a sample of *P. acnes* of at least one selected ribotype. the sample of *P. acnes* bacteria comprises *P. acnes* bacteria of ribotype RT1. In some embodiments, the sample of *P. acnes* bacteria comprises *P. acnes* bacteria of ribotype RT2. In some embodiments, the sample of *P. acnes* bacteria comprises *P. acnes* bacteria of ribotypes RT1 and RT2. In some embodiments, the sample of *P. acnes* bacteria consists essentially of *P. acnes* bacteria of ribotype RT1. In some embodiments, the sample of *P. acnes* bacteria consists essentially of *P. acnes* bacteria of ribotype RT2. In some embodiments, the sample of *P. acnes* bacteria consists essentially of *P. acnes* bacteria of ribotypes RT1 and RT2.

In some embodiments, methods may comprise culturing an initial culture of the sample of *P. acnes* bacteria. The initial culture may be a smaller aliquot of the *Propionibacterium* and the method may comprise proliferating the *Propionibacterium* to obtain a desired amount. In some embodiments, methods may comprise culturing the initial culture in a culture medium. In some embodiments, the cell culture medium comprises reinforced clostridial medium. In some embodiments, the cell culture medium consists essentially of reinforced clostridial medium. In some embodiments, the cell culture medium comprises Luria broth. In some embodiments, the cell culture medium comprises tryptone broth. In some embodiments, methods comprise at least one step of splitting, diluting or passaging the initial culture or product thereof in the culture medium. In some embodiments, the methods comprise at least one step of washing the sample of the initial culture or product thereof. In some embodiments, the methods comprise at least one step of centrifuging or pelleting the initial culture or product thereof. In some embodiments, the culture is centrifuged at about 3500 rcf to about 4500 rcf. In some embodiments, the culture is centrifuged at about 3800 rcf to about 4200 rcf. In some embodiments, the culture is centrifuged at about 4000 rcf. In some embodiments, the methods comprise at least one step of vortexing the initial culture or product thereof. In some embodiments, the methods comprise at least one step of pipetting the initial culture of product thereof. Any one of the steps described herein may be performed at least one time. Any one of the steps described herein may be performed two times. Any one of the steps described herein may be performed three times. In some embodiments, methods comprise adding a sachet to a culture comprising the sample of *Propionibacterium* or an initial culture thereof. In some embodiments the sachet reduces oxygen exposure to the *Propionibacterium*.

Compositions of Preserved *Propionibacterium*

Provided herein, in some aspects, are compositions that comprise a preserved sample of bacteria, wherein the bacteria comprises *Propionibacterium*. In some embodiments, compositions disclosed herein comprise *P. acnes* bacteria of ribotype RT1. In some embodiments, the compositions comprise *P. acnes* bacteria of ribotype RT2. In some embodiments, the compositions comprise *P. acnes* bacteria of ribotype RT1 and RT2. In some embodiments, the bacteria of the compositions consist essentially of *P. acnes* bacteria of ribotype RT1. In some embodiments, the bacteria of the compositions consist essentially of *P. acnes* bacteria of ribotype RT2. In some embodiments, the compositions comprise *P. acnes* bacteria of ribotype RT1 and RT2.

In some embodiments, compositions disclosed herein comprise a sample of bacteria preserved in at least one cryopreservative agent. In some embodiments, the cryopreservative agent is a polyol. Non-limiting examples of polyols include DMSO, ethylene glycol, glycerol, propylene (PEG) glycol, sucrose, trehalose, and 2-Methyl-2,4-pentanediol (MPD). In various embodiments, the PEG may have a molecular weight between about 10 g/mol and about 10,000 g/mol. In various embodiments, the PEG may have a molecular weight between about 10 g/mol and about 5,000 g/mol. In various embodiments, the PEG may have a molecular weight between about 10 g/mol and about 1,000 g/mol. In various embodiments, the PEG may have a molecular weight between about 10 g/mol and about 500 g/mol.

In some embodiments, compositions disclose herein comprise polyethylene glycol. In some embodiments, a composition comprising polyethylene glycol allows for a reduced amount of glycerol, whilst maintaining viability of bacteria in the composition that is similar to viability of bacteria in compositions without polyethylene glycol and a greater amount of glycerol. In some embodiments, reducing or minimizing the amount of glycerol in a composition disclosed herein results in a formulation that has a texture that is more preferable to a subject. In some embodiments, reducing or minimizing the amount of glycerol in a composition disclosed herein results in a formulation that less comedogenic relative to a composition with a greater amount of glycerol.

In some embodiments, compositions disclosed herein comprise a sample of bacteria preserved in a mixture of a first polyol and a second polyol. In some embodiments, the first polyol or the second polyol is glycerol. In some embodiments, the first polyol or the second polyol is a polyethylene glycol. In some embodiments, compositions disclosed herein comprise a sample of bacteria preserved in a mixture of glycerol and polyethylene glycol. In some embodiments, the mixture is between about 1% glycerol v/v and about 50% glycerol v/v, and between about 1% polyethylene glycol w/v and about 50% w/v polyethylene glycol. In some embodiments, the mixture is between about 5% glycerol v/v and about 50% glycerol v/v, and between about 5% polyethylene glycol w/v and about 50% w/v polyethylene glycol. In some embodiments, the mixture is between about 5% glycerol v/v and about 30% glycerol v/v, and between about 5% polyethylene glycol w/v and about 40% w/v polyethylene glycol. In some embodiments, the mixture is between about 10% glycerol v/v and about 35% glycerol v/v, and between about 10% polyethylene glycol w/v and about 35% w/v polyethylene glycol.

In some embodiments, compositions disclose herein comprise a solution, wherein the solution is between about 1% glycerol v/v and about 75% glycerol v/v in solution. In some embodiments, the solution is between about 1% glycerol v/v and about 50% glycerol v/v in solution. In some embodiments, the solution is between about 1% glycerol v/v and about 40% glycerol v/v in solution. In some embodiments, the solution is between about 1% glycerol v/v and about 35% glycerol v/v in solution. In some embodiments, the solution is between about 1% glycerol v/v and about 30% glycerol v/v in solution. In some embodiments, the solution is between about 1% glycerol v/v and about 25% glycerol v/v in solution. In some embodiments, the solution is between about 1% glycerol v/v and about 20% glycerol v/v in solution. In some embodiments, the solution is between about 1% glycerol v/v and about 15% glycerol v/v in solution. In some embodiments, the solution is between about 5% glycerol v/v and about 50% glycerol v/v in solution. In some embodiments, the solution is between about 5% glycerol v/v and about 40% glycerol v/v in solution. In some embodiments, the solution is between about 5% glycerol v/v and about 35% glycerol v/v in solution. In some embodiments, the solution is between about 5% glycerol v/v and about 30% glycerol v/v in solution. In some embodiments, the solution is between about 5% glycerol v/v and about 25% glycerol v/v in solution. In some embodiments, the solution is between about 10% glycerol v/v and about 40% glycerol v/v in solution. In some embodiments, the solution is between about 10% glycerol v/v and about 35% glycerol v/v in solution. In some embodiments, the solution is between about 10% glycerol v/v and about 30% glycerol v/v in solution. In some embodiments, the solution is between about 10% glycerol v/v and about 25% glycerol v/v in solution. In some embodiments, the solution is between about 15% glycerol v/v and about 40% glycerol v/v in solution. In some embodiments, the solution is between about 15% glycerol v/v and about 35% glycerol v/v in solution. In some embodiments, the solution is between about 15% glycerol v/v and about 30% glycerol v/v in solution. In some embodiments, the solution is between about 15% glycerol v/v and about 25% glycerol v/v in solution. In some embodiments, the solution is between about 20% glycerol v/v and about 50% glycerol v/v in solution. In some embodiments, the solution is between about 20% glycerol v/v and about 40% glycerol v/v in solution. In some embodiments, the solution is between about 20% glycerol v/v and about 30% glycerol v/v in solution.

In some embodiments, compositions disclose herein comprise a solution, wherein the solution is between about 1% polyethylene glycol w/v and about 75% polyethylene glycol w/v in solution. In some embodiments, the solution is between about 1% polyethylene glycol w/v and about 50% polyethylene glycol w/v in solution. In some embodiments, the solution is between about 1% polyethylene glycol w/v and about 40% polyethylene glycol w/v in solution. In some embodiments, the solution is between about 1% polyethylene glycol w/v and about 35% polyethylene glycol w/v in solution. In some embodiments, the solution is between about 1% polyethylene glycol w/v and about 30% polyethylene glycol w/v in solution. In some embodiments, the solution is between about 1% polyethylene glycol w/v and about 25% polyethylene glycol w/v in solution. In some embodiments, the solution is between about 1% polyethylene glycol w/v and about 20% polyethylene glycol w/v in solution. In some embodiments, the solution is between about 1% polyethylene glycol w/v and about 15% polyethylene glycol w/v in solution. In some embodiments, the solution is between about 5% polyethylene glycol w/v and about 50% polyethylene glycol w/v in solution. In some embodiments, the solution is between about 5% polyethylene glycol w/v and about 40% polyethylene glycol w/v in solution. In some embodiments, the solution is between about 5% polyethylene glycol w/v and about 35% polyethylene glycol w/v in solution. In some embodiments, the solution is between about 5% polyethylene glycol w/v and about 30% polyethylene glycol w/v in solution. In some embodiments, the solution is between about 5% polyethylene glycol w/v and about 25% polyethylene glycol w/v in solution. In some embodiments, the solution is between about 10% polyethylene glycol w/v and about 40% polyethylene glycol w/v in solution. In some embodiments, the solution is between about 10% polyethylene glycol w/v and about 35% polyethylene glycol w/v in solution. In some embodiments, the solution is between about 10% polyethylene glycol w/v and about 30% polyethylene glycol w/v in solution. In some embodiments, the solution is between about 10% polyethylene glycol w/v and about 25% polyethylene glycol w/v in solution. In some embodiments, the solution is between about 15% polyethylene glycol w/v and about 40% polyethylene glycol w/v in solution. In some embodiments, the solution is between about 15% polyethylene glycol w/v and about 35% polyethylene glycol w/v in solution. In some embodiments, the solution is between about 15% polyethylene glycol w/v and about 30% polyethylene glycol w/v in solution. In some embodiments, the solution is between about 15% polyethylene glycol w/v and about 25% polyethylene glycol w/v in solution. In some embodiments, the solution is between about 20% polyethylene glycol w/v and about 50% polyethylene glycol w/v in solution. In some embodiments, the solution is between about 20% polyethylene glycol w/v and about 40% polyethylene glycol w/v in solution. In some embodiments, the solution is between about 20% polyethylene glycol w/v and about 30% polyethylene glycol w/v in solution.

In some embodiments, the solution is about 5% glycerol v/v in solution. In some embodiments, the solution is about 10% glycerol v/v in solution. In some embodiments, the solution is about 15% glycerol v/v in solution. In some embodiments, the solution is about 20% glycerol v/v in solution. In some embodiments, the solution is about 25% glycerol v/v in solution. In some embodiments, the solution is about 30% glycerol v/v in solution. In some embodiments, the solution is about 35% glycerol v/v in solution. In some embodiments, the solution is about 40% glycerol v/v in solution. In some embodiments, the solution is about 45% glycerol v/v in solution. In some embodiments, the solution is about 50% glycerol v/v in solution. In some embodiments, the solution is about 55% glycerol v/v in solution. In some embodiments, the solution is about 60% glycerol v/v in solution. In some embodiments, the solution is about 70% glycerol v/v in solution.

In some embodiments, compositions disclosed herein comprise a solution, wherein the solution comprises glycerol and water. In some embodiments, the solution consists essentially of glycerol and water. In some embodiments, methods comprise storing *Propionibacterium* in a solution, wherein the solution comprises glycerol and a saline solution. In some embodiments, the solution consists essentially of glycerol and a saline solution. In some embodiments, the solution comprises glycerol and a buffered saline solution. In some embodiments, the solution consists essentially of glycerol and a buffered saline solution. In some embodiments, the solution comprises glycerol and a buffered solution. In some embodiments, the buffered solution comprises sodium bicarbonate, citric acid or triethanolamine. In some embodiments, the solution comprises glycerol and a phosphate buffered saline solution. In some embodiments, the solution consists essentially of glycerol and a phosphate buffered saline solution.

In some embodiments, compositions disclosed herein comprise a solution, wherein the solution has a pH of between about 3.5 and about 7. In some embodiments, the solution has a pH of between about 4 and about 6.5. In some embodiments, the solution has a pH of between about 4 and about 6. In some embodiments, the solution has a pH of between about 4 and about 5.5. In some embodiments, the solution has a pH of between about 4.5 and about 5.5. In some embodiments, the solution has a pH of between about 4.8 and about 5. In some embodiments, the solution has a pH of about 4. In some embodiments, the solution has a pH of about 4.2. In some embodiments, the solution has a pH of about 4.4. In some embodiments, the solution has a pH of about 4.6. In some embodiments, the solution has a pH of about 4.8. In some embodiments, the solution has a pH of about 5. In some embodiments, the solution has a pH of about 5.2. In some embodiments, the solution has a pH of about 5.4. In some embodiments, the solution has a pH of about 5.6. In some embodiments, the solution has a pH of about 5.8. In some embodiments, the solution has a pH of about 6.

In some embodiments, compositions disclosed herein comprise a solution, wherein the solution comprises a salt or ion thereof. In some embodiments, the solution comprises an ion selected from potassium, calcium, magnesium, sodium, and boron. In some embodiments, the solution comprises potassium. In some embodiments, the solution comprises potassium. In some embodiments, the concentration of the salt or ion thereof is between about 0.001 mM and about 1 mM. In some embodiments, the concentration of the salt or ion thereof is between about 0.001 mM and about 0.1 mM. In some embodiments, the concentration of the salt or ion thereof is between about 0.01 mM and about 0.1 mM. In some embodiments, the concentration of the salt or ion thereof is between about 0.05 mM and about 0.1 mM. In some embodiments, the concentration of the salt or ion thereof is between about 0.01 mM and about 1 mM. In some embodiments, the concentration of the salt or ion thereof is between about 0.1 mM and about 1 mM. In some embodiments, the concentration of the salt or ion thereof is between about 100 mM and about 250 mM. In some embodiments, the concentration of the salt or ion thereof is between about 125 mM and about 225 mM. In some embodiments, the concentration of the salt or ion thereof is between about 150 mM and about 200 mM. In some embodiments, the concentration of potassium is between about 100 mM and about 250 mM. In some embodiments, the concentration of potassium is between about 125 mM and about 225 mM. In some embodiments, the concentration of potassium is between about 150 mM and about 200 mM. In some embodiments, the solution comprises calcium at a concentration of about 0.001 mM to about 1 mM. In some embodiments, the solution comprises calcium at a concentration of about 0.01 mM to about 0.5 mM. In some embodiments, the solution comprises calcium at a concentration of about 0.05 mM to about 0.1 mM.

In some embodiments, compositions disclosed herein comprise a solution, wherein the solution comprises at least one stabilizing agent. In some embodiments, the stabilizing agent is selected from inulin, sucrose, trehalose, cornstarch, maltodextrin, guar guy, locust bean gum, and xanthan gum. In some embodiments, trehalose or sucrose stabilizes bacteria for cold-chain free stability. In some embodiments, the stabilizing agent is inulin. In some embodiments, the stabilizing agent is present in the solution at a concentration of about 0.01% v/v to about 1% v/v. In some embodiments, the stabilizing agent is present in the solution at a concentration of about 0.01% v/v to about 0.5% v/v. In some embodiments, the stabilizing agent is present in the solution at a concentration of about 0.05% v/v to about 0.2% v/v. In some embodiments, the solution comprises inulin at a concentration of about 0.01% v/v to about 1% v/v. In some embodiments, the solution comprises inulin at a concentration of about 0.01% v/v to about 0.5% v/v. In some embodiments, the solution comprises inulin at a concentration of about 0.05% v/v to about 0.2% v/v.

In some embodiments, compositions disclosed herein comprise a solution, wherein the solution comprises an anti-acne agent, wherein the anti-acne agent is an agent that prevents, reduces or abolishes acne. In some embodiments, the anti-acne agent is selected from a retinoid, a vitamin, an antioxidant, a peroxide, an acid, an oil, an alcohol, an extract, and analogs thereof. In some embodiments, the retinoid is selected from tretinoin, tazarotene, adapalene, and retinol. In some embodiments, the vitamin or analog thereof is selected from Vitamin D, Vitamin C, Vitamin E, and calciptotriene. In some embodiments, the antioxidant is selected from Vitamin C and Vitamin E. peroxide is benzoyl peroxide. In some embodiments, the acid is selected from salicylic acid, azaelic acid, trichloracetic acid, and glycolic acid. In some embodiments, the alcohol is selected from retinol and resveratrol. In some embodiments, the oil is tea tree oil. In some embodiments, the extract is a green tea extract.

In some embodiments, compositions disclosed herein comprise a solution, wherein the solution is incorporated in a biologic stability platform. In some embodiments, the biologic stability platform eliminates a need for temperature control, e.g., cold chain storage. In some embodiments, the biologic storage platform comprises foam drying or foam formation of the solution or glycerol stock solution. In some embodiments, the biologic stability platform comprises at least one of a glyconanoparticle, a liposome, a nanoparticle, trehalose, sucrose, stachyose, hydroxyethyl starch, and a combination of glycine and mannitol.

In some embodiments, compositions disclosed herein have a temperature of about −80° C. to about 10° C. In some embodiments, the composition is at a temperature of about −80° C. to about 4° C. In some embodiments, the composition is at a temperature of about −40° C. to about 10° C. In some embodiments, the composition is at a temperature of about −25° C. to about 10° C. In some embodiments, the composition is at a temperature of about −20° C. to about 4° C. In some embodiments, the composition is at a temperature of about −90° C. to about −70° C. In some embodiments, the composition is at a temperature of about −30° C. to about −10° C. In some embodiments, the composition is at a temperature of about −80° C. In some embodiments, the composition is at a temperature of about −20° C. In some embodiments, the composition is at a temperature of about 4° C.

In some embodiments, compositions disclosed herein comprise a *Propionibacterium* glycerol stock, wherein at least about 60% to at least about 90% of the *Propionibacterium* sample is viable after the *Propionibacterium* glycerol stock is brought to ambient temperature. In some embodiments, the at least about 70% to at least about 90% of the *Propionibacterium* sample is viable after the *Propionibacterium* glycerol stock is brought to ambient temperature. In some embodiments, the at least about 80% to at least about 90% of the viable after the *Propionibacterium* glycerol stock is brought to ambient temperature. In some embodiments, at least about 60% of the *P. acnes* sample is viable after the *Propionibacterium* glycerol stock is brought to ambient temperature. In some embodiments, at least about 70% of the *Propionibacterium* sample is viable after the *Propionibacterium* glycerol stock is brought to ambient temperature. In some embodiments, at least about 80% of the *Propionibacterium* sample is viable after the *Propionibacterium* glycerol stock is brought to ambient temperature. In some embodiments, at least about 90% of the *Propionibacterium* sample is viable after the *Propionibacterium* glycerol stock is brought to ambient temperature. Ambient temperature is considered an acceptable room temperature. In some embodiments, the ambient temperature is between about 25° C. and about 35° C. In some embodiments, the ambient temperature is between about 20° C. and about 30° C. In some embodiments, the ambient temperature is between about 22° C. and about 28° C. In some embodiments, the ambient temperature is about 25° C.

In some embodiments, compositions disclosed herein comprise a *Propionibacterium* glycerol stock, wherein at least about 50% of the *Propionibacterium* sample is viable after at least about 30 days of storing. In some embodiments, at least about 60% of the *Propionibacterium* sample is viable after at least about 30 days of storing. In some embodiments, at least about 70% of the *P. acnes* sample is viable after at least about 20 days of storing. In some embodiments, at least about 80% of the *Propionibacterium* sample is viable after at least about 30 days of storing. In some embodiments, at least about 90% of the *Propionibacterium* sample is viable after at least about 30 days of storing. In some embodiments, at least about 95% of the *Propionibacterium* sample is viable after at least about 30 days of storing. In some embodiments, at least about 50% of the *Propionibacterium* sample is viable after at least about 60 days of storing. In some embodiments, at least about 60% of the *Propionibacterium* sample is viable after at least about 60 days of storing. In some embodiments, at least about 70% of the *Propionibacterium* sample is viable after at least about 60 days of storing. In some embodiments, at least about 80% of the *Propionibacterium* sample is viable after at least about 60 days of storing. In some embodiments, at least about 90% of the *Propionibacterium* sample is viable after at least about 60 days of storing. In some embodiments, at least about 95% of the *Propionibacterium* sample is viable after at least about 60 days of storing. In some embodiments, at least about 50% of the *Propionibacterium* sample is viable after at least about 90 days of storing. In some embodiments, at least about 60% of the *Propionibacterium* sample is viable after at least about 90 days of storing. In some embodiments, at least about 70% of the *Propionibacterium* sample is viable after at least about 90 days of storing. In some embodiments, at least about 80% of the *Propionibacterium* sample is viable after at least about 90 days of storing. In some embodiments, at least about 90% of the *Propionibacterium* sample is viable after at least about 90 days of storing. In some embodiments, at least about 95% of the *Propionibacterium* sample is viable after at least about 90 days of storing. In some embodiments, at least about 50% of the *Propionibacterium* sample is viable after at least about 120 days of storing. In some embodiments, at least about 60% of the *Propionibacterium* sample is viable after at least about 120 days of storing. In some embodiments, at least about 70% of the *Propionibacterium* sample is viable after at least about 120 days of storing. In some embodiments, at least about 80% of the *Propionibacterium* sample is viable after at least about 120 days of storing. In some embodiments, at least about 90% of the *Propionibacterium* sample is viable after at least about 120 days of storing. In some embodiments, at least about 95% of the *Propionibacterium* sample is viable after at least about 120 days of storing. In some embodiments, at least about 50% of the *Propionibacterium* sample is viable after at least about 180 days of storing. In some embodiments, at least about 60% of the *Propionibacterium* sample is viable after at least about 180 days of storing. In some embodiments, at least about 70% of the sample is viable after at least about 180 days of storing. In some embodiments, at least about 80% of the *Propionibacterium* sample is viable after at least about 180 days of storing. In some embodiments, at least about 90% of the *Propionibacterium* sample is viable after at least about 180 days of storing. In some embodiments, at least about 95% of the *Propionibacterium* sample is viable after at least about 180 days of storing. In some embodiments, at least about 50% of the *Propionibacterium* sample is viable after at least about a year of storing. In some embodiments, at least about 60% of the *Propionibacterium* sample is viable after at least about a year of storing. In some embodiments, at least about 70% of the *Propionibacterium* sample is viable after at least about a year of storing. In some embodiments, at least about 80% of the *Propionibacterium* sample is viable after at least about a year of storing. In some embodiments, at least about 90% of the *Propionibacterium* sample is viable after at least about a year of storing. In some embodiments, at least about 95% of the *Propionibacterium* sample is viable after at least about a year of storing.

In some embodiments, compositions disclosed herein have a storage life of at least about thirty days to at least about ninety days. In some embodiments, the compositions disclosed herein have a storage life of at least about 30 days to at least about 120 days. In some embodiments, the compositions disclosed herein have a storage life of at least about 30 days to at least about 180 days. In some embodiments, the compositions disclosed herein have a storage life of at least about thirty days to about ninety days. In some embodiments, the compositions disclosed herein have a storage life of at least about 30 days to about 120 days. In some embodiments, the compositions disclosed herein have a storage life of at least about 30 days to about 180 days. In some embodiments, the compositions disclosed herein have a storage life of at least about thirty days. In some embodiments, the compositions disclosed herein have a storage life of at least about sixty days. In some embodiments, the compositions disclosed herein have a storage life of at least about ninety days. In some embodiments, the compositions disclosed herein have a storage life of at least about 120 days. In some embodiments, the compositions disclosed herein have a storage life of at least about 180 days. In some embodiments, the compositions disclosed herein have a storage life of at least about 240 days. In some embodiments, the compositions disclosed herein have a storage life of at least about one year. In some embodiments, the compositions disclosed herein have a storage life of up to about one year.

In some embodiments, the compositions disclosed herein are capable of being thawed and subsequently applied to a subject in need thereof. In some embodiments, the compositions disclosed herein are capable of being warmed and subsequently applied to a subject in need thereof. In some embodiments, the compositions disclosed herein are capable of being refrigerated and subsequently applied to a subject in need thereof. In some embodiments, subsequently applied to the subject comprises applying the composition directly to the skin of the subject. In some embodiments, subsequently applied to the subject comprises applying the composition to an application composition before being applied to the skin. The application composition may be selected from a liquid, gel, lotion, emollient, paste, mask, and virtually any solution that can be applied to the skin of a subject. In some embodiments, the application composition is free of any anti-acne agent. In some embodiments, the application composition comprises an anti-acne agent. In some embodiments, the compositions disclosed herein are capable of being applied directly from a frozen stock to skin of a subject without thawing or warming.

TABLE 8

Exemplary Sequences (Additional SEQ IDs provided in sequence listing filed herewith). Bold characters highlight differences between Type I lipase and Type II lipase.

| SEQ ID NO. | Description | Sequence |
|---|---|---|
| 60 | Type I lipase | gtagatacagatacatctgaggagat ccatgaagaaaaactggttactcaca accctccttgccacaatgatgatcgc catgggcacgacgaccaccgccttcg ccagcccgcctaccgacatcactccc gaacatccaggcggggttaccgcgcc tcacagccccgacggaatcccctcga atattgagggggccaagtatgcccagc tggacctctgcaatcaggttcgcaat gaagaacccggcacgaaagtcccgg gcaccaacgacttcacctgcaaaccg aggaaaggcacccatcccgtcgtgct catcccgggcacatccgaggacgcct tcatcacgtggtcgtactacggtccc cgccaggattctgcgcctacacgttc aactacaacccggaaacacatccgct tgtggaagccgctgagaccagcggca acatctactccacggcagctttcatg gcccacttcgttgacagagtgctcaa ggcaaccggtgctcagaaggtcaacc tcgtcggccattctcagggcggcggc ccctgccgcgcgcgtacatcaaata ttacggggcgccaagaaagtcctcat ctcgtcggtttggttccttccaacag gggaacacgcatgctcggcctggaga agttcctcaatgccagcggaaaccgg ctcagcactatcttcaatgctgcagc acagtttcgaaagctggaatccctgc cccaacagttgcaagactccacattt ctcagggaactcaacgcggatggaat gaccgtccccggcatcacatacaccg tcatcgccacccagttcgacaaccga gtatttccgtggactaataccttcat caatgagcccggggtcaagaacatcg tcatccaagacgtctgtcccttggac cacagcgcccacacggatatccctag gacccgatgacccttcagattgtcat caacgccttggacccccgagcgggccg ccccggtcacctgcaccattcgccca ttcaggcccagttag |
| 61 | Type II lipase | gcagatgcatctgagaagatccatga agaaaaactggttactcacaaccctc cttgccacaatgatgatcgccatggg cacgacgaccaccgccttcgccagcc cgcctaccgacatcactcccgaacat ccaggcggggttacccgcctcacagc cccgacggaatcccctcgaatattga ggggccaagtatgcccagctggacct ctgcaatcaggttcgcaatgaagaac cccggcacgaaagtcccgggcaccaa cgacttcacctgcaaaccgaggaaag |

TABLE 8-continued

Exemplary Sequences (Additional SEQ IDs provided in sequence listing filed herewith). Bold characters highlight differences between Type I lipase and Type II lipase.

| SEQ ID NO. | Description | Sequence |
|---|---|---|
| | | gcacccatcccgtcgtgctcatcccg ggcacatccgaggacgccttcatcac gtggtcgtactacggtccccgccagg attctgcgcctacacgttcaactaca acccggaaacacatccgcttgtggaa gccgctgagaccagcggcaacatcta ctccacggcagctttcatggcccact tcgttgacagagtgctcaaggcaacc ggtgctcagaaggtcaacctcgtcgg ccattctcagggcggcggcccccctgc cgcgcgcgtacatcaaatattacggg gcgccaagaaagtcctcatctcgtcg gtttggttccttccaacaggggaaca cgcatgctcggcctggagaagttcct caatgccagcggaaacccgctcagca ctatcttcaatgctgcagcacagttt cgaaagctggaatccctgccccaaca gttgcaagactccacatttctcaggg aactcaacgcggatggaatgaccgtc cccggcatcacatacaccgtcatcgc cacccagttcgacaaccgagtatttc cgtggactaataccttcatcaatgag cccggggtcaagaacatcgtcatcca agacgtctgtcccttggaccacagcg cccacacggatatccctaggacccga tgacccttcagattgtcatcaacgcc ttggaccccgagcgggccgccccggt cacctgcaccattcgcccattcaggc ccagttag |

The disclosure is further understood through review of the numbered embodiments recited herein. Various embodiments contemplated herein may include, but need not be limited to, one or more of the following, and combinations thereof:

1. A pharmaceutical probiotic composition comprising: (a) a therapeutically effective amount of a health-associated *Propionibacterium acnes* microbe, wherein the health-associated *Propionibacterium acnes* microbe has been engineered or selected to comprise at least one gene encoding at least one of a deoxyribose operon repressor and a type II lipase, and less than about 10% pIMPLE plasmid; and (b) a pharmaceutically acceptable excipient or biological stabilizer. 2. The pharmaceutical probiotic composition of embodiment 1, wherein the health-associated *Propionibacterium acnes* microbe has been engineered or selected to comprise a deoxyribose operon repressor and a type II lipase. 3. The pharmaceutical probiotic composition of embodiment 1 or 2, wherein a Cas 5 protein is absent from the health-associated *Propionibacterium acnes* microbe. 4. The pharmaceutical probiotic composition of any one of embodiments 1-3, wherein the health-associated *Propionibacterium acnes* microbe comprises an RT1 or RT2 ribotype. 5. The pharmaceutical probiotic composition of any one of embodiments 1-4, wherein the health-associated *Propionibacterium acnes* microbe does not comprise an RT6 ribotype. 6. The pharmaceutical probiotic composition of any one of embodiments 1-5, wherein the health-associated *Propionibacterium acnes* microbe comprises less than about 1% pIMPLE plasmid. 7. The pharmaceutical probiotic composition of any one of embodiments 1-6, wherein the health-associated *Propionibacterium acnes* microbe comprises less than about 0.3% pIMPLE plasmid. 8. The pharmaceutical probiotic composition of any one of embodiments 1-7, wherein the health-associated *Propionibacterium acnes* microbe comprises a mixture of two or more different ribotypes of *Propionibacterium acnes*. 9. The pharmaceutical probiotic composition of any one of embodiments 1-8, wherein the pharmaceutically acceptable excipient or biological stabilizer increases the viability of the health-associated *Propionibacterium acnes* microbe at a temperature from about −10° C. to about 30° C. 10. The pharmaceutical probiotic composition of any one of embodiments 1-9, comprising at least one of an HP3A11 strain of *P. acnes*, an HP3B4 strain of *P. acnes*, an HP4G1 strain of *P. acnes*, or an HP5G4 strain of *P. acnes*. 11. The pharmaceutical probiotic composition of any one of embodiments 1-10, comprising at least one additional strain of bacteria comprising *Propionibacterium avidum*, *Propionibacterium acnes* subsp. *defendens*, or *Propionibacterium granulosum*. 12. The pharmaceutical probiotic composition of any one of embodiments 1-11, wherein the health-associated *Propionibacterium acnes* microbe expresses an ATP binding cassette transporter. 13. The pharmaceutical probiotic composition of any one of embodiments 1-12, wherein the health-associated *Propionibacterium acnes* microbe does not express a DNA binding response regulator or a phosphoglycerate kinase. 14. A method of treating a skin disorder or condition comprising applying a therapeutically effective amount of a pharmaceutical probiotic composition comprising: (a) therapeutically effective amount of a health-associated *Propionibacterium acnes* microbe, wherein the health-associated *Propionibacterium acnes* microbe has been engineered or selected to comprise at least one gene encoding at least one of a deoxyribose operon repressor and a type II lipase, and less than about 10% pIMPLE plasmid; and (b) a pharmaceutically acceptable excipient or biological stabilizer. 15. The method of embodiment 14, wherein the skin disorder or condition comprises acne, eczema, seborrheic dermatitis, psoriasis, or rosacea. 16. The method of embodiment 14 or 15, wherein the health-associated *Propionibacterium acnes* microbe has been engineered or selected to at least one gene encoding the deoxyribose operon repressor and the type II lipase. 17. The method of any one of embodiments 14-16, wherein a CRISPR locus or portion thereof is absent from the health-associated *Propionibacterium acnes* microbe. 18. The method of any one of embodiments 14-17, wherein the health-associated *Propionibacterium acnes* microbe comprises an RT1 or RT2 ribotype. 19. The method of any one of embodiments 14-18, wherein the health-associated *Propionibacterium acnes* microbe does not comprise an RT6 ribotype. 20. The method of any one of embodiments 14-19, wherein the health-associated *Propionibacterium acnes* microbe comprises less than about 1% pIMPLE plasmid. 21. The method of any one of embodiments 14-20, wherein the health-associated *Propionibacterium acnes* microbe comprises less than about 0.3% pIMPLE plasmid. 22. The method of any one of embodiments 14-21, wherein the health-associated *Propionibacterium acnes* microbe comprises a mixture of two or more different ribotypes. 23. The method of any one of embodiments 14-22, wherein the pharmaceutically acceptable excipient or biological stabilizer increases the viability of the health-associated *Propionibacterium acnes* microbe at a temperature from about −10° C. to about 30° C. 25. 24. The method of any one of embodiments 14-23, wherein the health-associated *Propionibacterium acnes* microbe comprises at least one of an HP3A11 strain, an HP3B4 strain, an HP4G1, or an HP5G4 strain. 25. The method of any one of embodiments 14-24, wherein the pharmaceutical probiotic composition comprises an additional strain of bacteria comprising *Propionibacterium avidum*, *Propionibacterium acnes* subsp. *defendens* or *Propionibacterium granulosum*. 26. A pharmaceutical probiotic composition comprising: (a) a first therapeutically effective amount of a first health-associated *Propionibacterium acnes* microbe, wherein the first health-associated *Propionibacterium acnes* microbe has been engineered or selected to at least one gene encoding at least one of a deoxyribose operon repressor and a type II lipase, and less than about 10% pIMPLE plasmid; (b) a second therapeutically effective amount of a second health-associated *Propionibacterium acnes* microbe, wherein the second health-associated *Propionibacterium acnes* microbe has been engineered or selected to comprise at least one gene encoding at least one of a deoxyribose operon repressor and a type II lipase, and less than about 10% pIMPLE plasmid; and (c) a pharmaceutically acceptable excipient or biological stabilizer. 27. The pharmaceutical probiotic composition of embodiment 26, wherein the first or the second health-associated *Propionibacterium acnes* microbe has been engineered or selected to comprise: (i) at least one gene encoding the deoxyribose operon repressor and the type II lipase, (ii) at least one gene encoding the deoxyribose operon repressor and less than about 10% pIMPLE plasmid, or (iii) at least one gene encoding the type II lipase and less than about 10% pIMPLE plasmid. 28. The pharmaceutical probiotic composition of embodiment 26 or 27, wherein the first and the second health-associated *Propionibacterium acnes* microbe has been engineered or selected to comprise: (i) at least one gene encoding the deoxyribose operon repressor and the type II lipase, (ii) at least one gene encoding the deoxyribose operon repressor and less than about 10% pIMPLE plasmid, or (iii) at least one gene encoding the type II lipase and less than about 10% pIMPLE plasmid. 29. The pharmaceutical probiotic composition of any one of embodiments 26-28, wherein the first or the second health-associated *Propionibacterium acnes* microbe has been engineered or selected to comprise at least one gene encoding the deoxyribose operon repressor, the type II lipase, and less than about 10% pIMPLE plasmid. 30. The pharmaceutical probiotic composition of any one of embodiments 26-29, wherein the first and the second health-associated *Propionibacterium acnes* microbe has been engineered or selected to comprise at least one gene encoding the deoxyribose operon repressor, the type II lipase, and less than about 10% pIMPLE plasmid. 31. The pharmaceutical probiotic composition of any one of embodiments 26-30, wherein the first and the second health-associated *Propionibacterium acnes* microbes are different strains. 32. The pharmaceutical probiotic composition of any one of embodiments 26-31, wherein the first or the second health-associated *Propionibacterium acnes* microbe comprises an RT1 or RT2 ribotype. 33. The pharmaceutical probiotic composition of any one of embodiments 26-32, wherein the first health-associated *Propionibacterium acnes* microbe comprises an RT1 ribotype and the second health-associated *Propionibacterium acnes* microbe comprises an RT2 ribotype. 34. The pharmaceutical probiotic composition of any one of embodiments 26-33, wherein neither the first nor the second health-associated *Propionibacterium acnes* microbe comprises an RT6 ribotype. 35. The pharmaceutical probiotic composition of any one of embodiments 26-34, wherein the pharmaceutically acceptable excipient or biological stabilizer increases the viability of the health-associated *Propionibacterium acnes* microbe at a temperature from about −10° C. to about −30° C. 36. The pharmaceutical probiotic composition of any one of embodiments 26-35, for use in the treatment of a skin disorder or condition. 37. The pharmaceutical probiotic composition of any one of embodiments 26-36, wherein the health-associated *Propionibacterium acnes* microbe comprise an HP3A11 strain, an HP3B4 strain, an HP4G1 strain, or an HP5G4 strain. 38. The pharmaceutical probiotic composition of any one of embodiments 26-37, wherein the first or second health-associated *Propionibacterium acnes* microbe expresses an ATP binding cassette transporter. 39. The pharmaceutical probiotic composition of any one of embodiments 26-38, wherein the first or second health-associated *Propionibacterium acnes* microbe does not express a DNA binding response regulator or a phosphoglycerate kinase. 40. A method of producing a desired preparation of a *Propionibacterium acnes* bacteria, said method comprising: (a) adding a sample of the *Propionibacterium acnes* bacteria to a glycerol solution to produce a *Propionibacterium acnes* glycerol stock, and (b) storing the *Propionibacterium acnes* glycerol stock at a temperature of about 4° C. or less, wherein more than about 50% of the *P. acnes* bacteria is viable when the *Propionibacterium acnes* bacteria in the glycerol solution is brought to ambient temperature. 41. The method of embodiment 40, wherein the glycerol solution is between about 25% and about 75% glycerol. 42. The method of embodiment 40 or 41, wherein the glycerol solution is about 50% glycerol. 43. The method of any one of embodiments 40-42, wherein the temperature is between about 4° C. and about −80° C. 44. The method of any one of embodiments 40-43, wherein the temperature is about −20° C. 45. The method of any one of embodiments 40-44, wherein at least about 70% to at least about 90% of the sample is viable after the *Propionibacterium acnes* glycerol stock is brought to ambient temperature. 46. The method of any one of embodiments 40-45, wherein at least about 90% of the sample is viable after the *Propionibacterium acnes* glycerol stock is brought to ambient temperature. 47. The method of embodiment 45 or 46, wherein the ambient temperature is between about 20° C. and about 30° C. 48. The method of embodiment 45 or 46, wherein the ambient temperature is about 25° C. 49. The method of any one of embodiments 45-48, wherein the *Propionibacterium acnes* glycerol stock is brought to ambient temperature before about 90 days of storing. 50. The method of any one of embodiments 40-49, wherein more than 50% of the sample is viable after about 20 days of storing. 51. The method of any one of embodiments 40-49, wherein more than about 50% of the sample is viable after about 90 days of storing. 52. The method of any one of embodiments 40-49, wherein more than about 50% of the sample is viable at least up to about 90 days of storing. 53. The method of any one of embodiments 40-52, wherein *Propionibacterium acnes* bacteria comprises at least one of an HP3A11 strain, an HP3B4 strain, an HP4G1 strain, or an HP5G4 strain. 54. A method of producing a desired preparation of a preserved *Propionibacterium acnes* sample, wherein up to about 90% of said preserved *Propionibacterium acnes* sample is viable after sixty days of storage, said method comprising: (a) adding a sample of *Propionibacterium acnes* bacteria to a solution of between about 1% and about 50% glycerol in phosphate buffered saline solution to produce a *Propionibacterium acnes* glycerol stock; and (b) storing the *Propionibacterium acnes* glycerol stock at a temperature, wherein the temperature is between about −20° C. and about 30° C., thereby forming said desired preparation wherein up to about 90% of said sample of *Propionibacterium acnes* bacteria is viable after sixty days of storage. 55. A method of producing a desired preparation of a preserved *Propionibacterium acnes* sample, wherein up to about 90% of said preserved *Propionibacterium acnes* sample is viable after ninety days of storage, said method comprising: (a) adding a sample of *Propionibacterium acnes* bacteria to a solution of about 50% glycerol to produce a *Propionibacterium acnes* glycerol stock; and (b) freezing the *Propionibacterium acnes* glycerol stock at −20° C., thereby forming said desired preparation wherein up to about 90% of said sample of *Propionibacterium acnes* bacteria is viable after a thawing of the *Propionibacterium acnes* glycerol stock. 56. The method of embodiment 55, comprising thawing the *Propionibacterium acnes* glycerol stock at room temperature. 57. The method of embodiment 55 or 56, wherein the solution is about 1-50% glycerol v/v. 58. The method of any one of embodiments 55-57, wherein the solution is about 5-25% glycerol v/v. 59. The method of any one of embodiments 55-58, wherein the solution is a buffered solution. 60. The method of embodiment 59, wherein the buffered solution is selected from a phosphate buffered saline solution and an acetate buffered solution. 61. The method of any one of embodiments 55-60, wherein the solution comprises potassium. 62. The method of embodiment 61, wherein the solution comprises potassium at a concentration of about 150 mM to about 200 mM. 63. The method of any one of embodiments 55-62, wherein the solution comprises calcium. 64. The method of embodiment 63, wherein the solution comprises calcium at a concentration of about 0.05 mM to about 0.1 mM. 65. The method of any one of embodiments 55-64, wherein the solution comprises a prebiotic stabilizing agent. 66. The method of embodiment 65, wherein the prebiotic stabilizing agent is inulin. 67. The method of embodiment 66, wherein inulin is present in the solution at a concentration of about 0.05% v/v to about 0.2% v/v. 68. The method of any one of embodiments 55-67, wherein the solution comprises an anti-acne agent. 69. The method of embodiment 68, wherein the anti-acne agent comprises a retinoid, a vitamin, an antioxidant, a peroxide, an acid, an oil, an alcohol, an extract, an analog thereof, or a combination thereof. 70. The method of embodiment 69, wherein the retinoid comprises tretinoin, tazarotene, adapalene, retinol, or a combination thereof. 71. The method of embodiment 69, wherein the vitamin or analog thereof comprises Vitamin D, Vitamin C, Vitamin E, or calciptotriene. 72. The method of embodiment 69, wherein the antioxidant comprises Vitamin C or Vitamin E. 73. The method of embodiment 69, wherein the peroxide is benzoyl peroxide. 74. The method of embodiment 69, wherein the acid comprises salicylic acid, azaelic acid, trichloracetic acid, or glycolic acid. 75. The method of embodiment 69, wherein the alcohol comprises retinol or resveratrol. 76. The method of embodiment 69, wherein the oil is tea tree oil. 77. The method of embodiment 69, wherein the extract is a green tea extract. 78. The method of any one of embodiments 54-77, wherein the solution is incorporated in a biologic stability platform to eliminate cold chain storage. 79. The method of embodiment 78, wherein the biologic storage platform comprises foam drying or foam formation of the solution or glycerol stock solution. 80. The method of embodiment 78, wherein the solution comprises at least one of a glyconanoparticle, a liposome, a nanoparticle, trehalose, sucrose, stachyose, hydroxyethyl starch, or a combination of glycine and mannitol. 81. The method of any one of embodiments 54-80, wherein the sample of *Propionibacterium acnes* bacteria comprises *Propionibacterium acnes* bacteria of ribotype RT1. 82. The method of any one of embodiments 54-80, wherein the sample of *Propionibacterium acnes* bacteria comprises *Propionibacterium acnes* bacteria of ribotype RT2. 83. The method of any one of embodiments 54-80, wherein the sample of *Propionibacterium acnes* bacteria comprises *Propionibacterium acnes bacteria of ribotype RT1 and RT2. 84. The method of any one of embodiments 54-83, wherein the *Propionibacterium acnes* bacteria is characterized by at least one of the following: comprises a deoR protein; comprises a type II lipase; comprises less than 10% pIMPLE plasmid; does not comprise a Cas5 protein; comprises an ATP binding cassette transporter protein; does not comprise a DNA binding response regulator; and does not comprise a phosphoglycerate kinase. 85. The method of any one of embodiments 54-83, wherein the sample of *Propionibacterium acnes* bacteria comprises *Propionibacterium acnes* bacteria comprises an HP3A11 strain, an HP3B4 strain, an HP4G1 strain, an HP5G4 strain. 86. A pharmaceutical composition comprising: (a) a therapeutically effective amount of a health-associated *Propionibacterium acnes* microbe, wherein the health-associated *Propionibacterium acnes* microbe is characterized by at least one of the following: comprises at least one gene encoding at least one of a deoxyribose operon repressor and a type II lipase, and less than about 10% pIMPLE plasmid; comprises at least one gene encoding an ATP binding cassette transporter; or lacks at least one gene encoding a DNA binding response regulator or a phosphoglycerate kinase, and (b) a pharmaceutically acceptable excipient or biological stabilizer. 87. The pharmaceutical probiotic composition of embodiment 86, wherein the health-associated *Propionibacterium acnes* microbe has been engineered or selected to comprise a deoxyribose operon repressor and a type II lipase. 88. The pharmaceutical probiotic composition of embodiment 86 or 87, wherein a Cas5 protein is absent from the health-associated *Propionibacterium acnes* microbe. 89. The pharmaceutical probiotic composition of any one of embodiments 86-88, wherein the health-associated *Propionibacterium acnes* microbe expresses an ATP binding cassette transporter. 90. The pharmaceutical probiotic composition of any one of embodiments 86-89, wherein the health-associated *Propionibacterium acnes* microbe does not express a DNA binding response regulator or a phosphoglycerate kinase. 91. The pharmaceutical probiotic composition of any one of embodiments 86-90, wherein the health-associated *Propionibacterium acnes* microbe comprises an RT1 or RT2 ribotype. 92. The pharmaceutical probiotic composition of any one of embodiments 86-91, wherein the health-associated *Propionibacterium acnes* microbe does not comprise an RT6 ribotype. 93. The pharmaceutical probiotic composition of any one of embodiments 86-92, wherein the health-associated *Propionibacterium acnes* microbe comprises less than about 1% pIMPLE plasmid. 94. The pharmaceutical probiotic composition of any one of embodiments 86-93, wherein the health-associated *Propionibacterium acnes* microbe comprises less than about 0.3% pIMPLE plasmid. 95. The pharmaceutical probiotic composition of any one of embodiments 86-94, wherein the pharmaceutically acceptable excipient or biological stabilizer increases the viability of the health-associated *Propionibacterium acnes* microbe at a temperature from about −20° C. to about 30° C. 96. The pharmaceutical composition of any one of embodiments 86-95, wherein the health-associated *Propionibacterium acnes* microbe comprises a mixture of two or more different ribotypes of *Propionibacterium acnes*. 97. The pharmaceutical probiotic composition of any one of embodiments 86-96, wherein the health-associated *Propionibacterium acnes* microbe comprises an HP3A11 strain, an HP3B4 strain, an HP4G1 strain, or an HP5G4 strain. 98. The pharmaceutical probiotic composition of any one of embodiments 86-97, comprising an additional strain of bacteria, wherein the additional strain comprises *Propionibacterium avidum, Propionibacterium acnes* subsp. *defendens*, or *Propionibacterium granulosum*. 99. A method of treating a skin disorder or condition comprising applying a therapeutically effective amount of a pharmaceutical probiotic composition comprising: (a) a therapeutically effective amount of a health-associated *Propionibacterium acnes* microbe, wherein the health-associated *Propionibacterium acnes* microbe is characterized by at least one of the following: comprises at least one gene encoding at least one of a deoxyribose operon repressor and a type II lipase, and less than about 10% pIMPLE plasmid; comprises at least one gene encoding an ATP binding cassette transporter; or lacks at least one gene encoding a DNA binding response regulator or a phosphoglycerate kinase, and (b) a pharmaceutically acceptable excipient or biological stabilizer. 100. The method of embodiment 99, wherein the skin disorder or condition comprises acne, eczema, seborrheic dermatitis, psoriasis, or rosacea, or a combination thereof. 101. The method of embodiment 99 or 100, wherein the health-associated *Propionibacterium acnes* microbe has been engineered or selected to at least one gene encoding the deoxyribose operon repressor and the type II lipase. 102. The method of any one of embodiments 99 to 101, wherein a Cas5 protein is absent from the health-associated *Propionibacterium acnes* microbe. 103. The method of any one of embodiments 99 to 102, wherein the health-associated *Propionibacterium acnes* microbe comprises an RT1 or RT2 ribotype. 104. The method of any one of embodiments 99 to 103, wherein the health-associated *Propionibacterium acnes* microbe does not comprise an RT6 ribotype. 105. The method of any one of embodiments 99 to 104, wherein the health-associated *Propionibacterium acnes* microbe comprises less than about 1% pIMPLE plasmid. 106. The method of any one of embodiments 99 to 105, wherein the health-associated *Propionibacterium acnes* microbe comprises less than about 0.3% pIMPLE plasmid. 107. The method of any one of embodiments 99 to 106, wherein the pharmaceutically acceptable excipient or biological stabilizer increases the viability of the health-associated *Propionibacterium acnes* microbe at a temperature from about −20° C. to about 30° C. 108. The method of any one of embodiments 99 to 107, wherein the health-associated *Propionibacterium acnes* microbe comprises a mixture of two or more different ribotypes. 109. The method of any one of embodiments 99 to 108, wherein the health-associated *Propionibacterium acnes* microbe comprises an HP3A11 strain, an HP3B4 strain, an HP4G1 strain, or an HP5G4 strain. 110. The method of any one of embodiments 99 to 109, wherein the pharmaceutical probiotic composition comprises an additional strain of bacteria, wherein the additional strain comprises *Propionibacterium avidum, Propionibacterium acnes* subsp. *defendens*, or *Propionibacterium granulosum*. 111. A pharmaceutical probiotic composition comprising: (a) a first therapeutically effective amount of a first health-associated *Propionibacterium acnes* microbe, wherein the first health-associated *Propionibacterium acnes* microbe is characterized by at least one of the following: comprises at least one gene encoding at least one of a deoxyribose operon repressor and a type II lipase, and less than about 10% pIMPLE plasmid; comprises at least one gene encoding an ATP binding cassette transporter; or lacks at least one gene encoding a DNA binding response regulator or a phosphoglycerate kinase; (b) a second therapeutically effective amount of a second health-associated microbe; and (c) a pharmaceutically acceptable excipient or biological stabilizer. 112. The pharmaceutical probiotic composition of embodiment 111, wherein the second health-associated microbe is a strain of bacteria comprising *P. acnes, P. granulosum, P. acnes* subsp. *defendens* or *P. avidum*. 113. The pharmaceutical probiotic composition of claim 111 or 112, wherein the second health-associated microbe is characterized by at least one of the following: comprises at least one gene encoding at least one of a deoxyribose operon repressor and a type II lipase, and less than about 10% pIMPLE plasmid; comprises at least one gene encoding an ATP binding cassette transporter; or lacks at least one gene encoding a DNA binding response regulator or a phosphoglycerate kinase. 114. The pharmaceutical probiotic composition of any one of embodiments 111-113, wherein the second health-associated microbe is a strain of *P. acnes* bacteria of ribotype RT1 or RT2. 115. The pharmaceutical probiotic composition of any one of embodiments 111-114, wherein the first health-associated *Propionibacterium acnes* microbe or the second health-associated microbe comprises an isolated or purified strain of bacteria. 116. A pharmaceutical composition comprising: (a) a pharmaceutically acceptable excipient or biological stabilizer; and (b) a therapeutically effective amount of a health-associated *Propionibacterium acnes* microbe, wherein the health-associated *Propionibacterium acnes* microbe does not express a DNA binding response regulator, a phosphoglycerate kinase, or a combination thereof. 117. A pharmaceutical composition comprising: (a) a pharmaceutically acceptable excipient or biological stabilizer; and (b) a therapeutically effective amount of a health-associated *Propionibacterium acnes* microbe, wherein the health-associated *Propionibacterium acnes* microbe expresses an ATP-binding cassette transporter. 118. A pharmaceutical composition comprising: (a) a pharmaceutically acceptable excipient or biological stabilizer; and (b) a therapeutically effective amount of a health-associated *Propionibacterium acnes* microbe, wherein the health-associated *Propionibacterium acnes* microbe: does not express a DNA binding response regulator, a phosphoglycerate kinase, or a combination thereof; and expresses an ATP-binding cassette transporter. 119. The pharmaceutical of any one of embodiments 86, 116, and 118, wherein the DNA binding response regulator is encoded by a sequence of SEQ ID NO: 7. 120. The pharmaceutical of any one of embodiments 86, 116, and 118, wherein the DNA binding response regulator is encoded by a sequence that is at least 50% homologous to a sequence of SEQ ID NO: 7. 121. The pharmaceutical of any one of embodiments 86, 116, and 118, wherein the phosphoglycerate kinase is encoded by a sequence of SEQ ID NO: 9. 122. The pharmaceutical of any one of embodiments 86, 116, and 118, wherein the phosphoglycerate kinase is encoded by a sequence that is at least 50% homologous to a sequence of SEQ ID NO: 9. 123. The pharmaceutical of embodiment 116 or 117, wherein the ATP-binding cassette transporter is encoded by a sequence of SEQ ID NO: 6. 124. The pharmaceutical of any one of embodiments 86, 117, and 118, wherein the ATP-binding cassette transporter is encoded by a sequence that is at least 50% homologous to a sequence of SEQ ID NO: 6. 125. The pharmaceutical composition of any one of embodiments 86 and 116-124, comprising at least two strains of bacteria. 126. The pharmaceutical composition of any one of embodiments 86 and 116-125, comprising a strain of *Propionibacterium acnes* having a ribotype of RT1, RT2, RT3, RT4 or RT5. 127. The pharmaceutical composition of any one of embodiments 86 and 116-126, comprising a strain of *Propionibacterium acnes* having a ribotype of RT1 or RT2. 128. The pharmaceutical probiotic composition of any one of embodiments 86 and 116-127, wherein the health-associated *Propionibacterium acnes* microbe does not comprise an RT6 ribotype. 129. The pharmaceutical composition of any one of embodiments 86 and 116-128, wherein the pharmaceutical composition is formulated for topical administration. 130. The pharmaceutical composition of any one of embodiments 86 and 116-129, wherein the pharmaceutical composition is in the form of a gel, ointment, lotion, emulsion, paste, cream, foam, mousse, liquid, spray, suspension, dispersion and aerosol. 131. The pharmaceutical composition of any one of embodiments 86 and 116-130, comprising a liposome or nanoparticle. 132. The pharmaceutical probiotic composition of any one of embodiments 86 and 116-131, wherein the health-associated *Propionibacterium acnes* microbe comprises a deoxyribose operon repressor and a type II lipase. 133. The pharmaceutical probiotic composition of any one of embodiments 86 and 116-132, wherein a Cas5 protein is absent from the health-associated *Propionibacterium acnes* microbe. 134. The pharmaceutical probiotic composition of any one of embodiments 86 and 116-133, wherein the health-associated *Propionibacterium acnes* microbe comprises less than about 1% pIMPLE plasmid. 135. The pharmaceutical probiotic composition of any one of embodiments 86 and 116-133, wherein the health-associated *Propionibacterium acnes* microbe comprises less than about 0.3% pIMPLE plasmid. 136. The pharmaceutical composition of claim of any one of embodiments 86 and 116-135, wherein the health-associated *Propionibacterium acnes* microbe comprises a mixture of two or more different ribotypes of *Propionibacterium acnes*. 137. The pharmaceutical probiotic composition of any one of embodiments 86 and 116-136, wherein the pharmaceutically acceptable excipient or biological stabilizer increases the viability of the health-associated *Propionibacterium acnes* microbe at a temperature from about −10° C. to about 30° C. 138. The pharmaceutical probiotic composition of any one of embodiments 86 and 116-137, comprising an additional strain of bacteria. 139. The pharmaceutical probiotic composition of any one of embodiments 86 and 116-137, comprising an additional strain of bacteria, wherein the additional strain comprises *Propionibacterium avidum, Propionibacterium acnes* subsp. *defendens* or *Propionibacterium granulosum*. 140. The pharmaceutical probiotic composition of any one of embodiments 86 and 116-137, wherein the health-associated *Propionibacterium acnes* microbe is selected, transformed or engineered to: comprise at least one gene encoding at least one of a deoxyribose operon repressor and a type II lipase, and less than about 10% pIMPLE plasmid; comprise at least one gene encoding an ATP binding cassette transporter; or lack at least one gene encoding a DNA binding response regulator or a phosphoglycerate kinase. 141. A method of treating a skin disorder or condition comprising applying a therapeutically effective amount of a pharmaceutical composition of any one of embodiments 86 and 116-140. 142. The method of embodiment 141, wherein the skin disorder or condition comprises acne, eczema, seborrheic dermatitis, psoriasis, or rosacea, or a combination thereof 143. A pharmaceutical composition comprising: (a) a first therapeutically effective amount of a first health-associated *Propionibacterium* microbe, wherein the first health-associated *Propionibacterium* microbe produces less than about one micromolar porphyrin; (b) a second therapeutically effective amount of a second health-associated microbe; and (c) a pharmaceutically acceptable excipient or biological stabilizer. 144. The pharmaceutical composition of embodiment 143, wherein the second health-associated microbe comprises a strain of *Propionibacterium*. 145. The pharmaceutical composition of embodiment 143 or 144, wherein, wherein the second health-associated microbe produces less than about one micromolar porphyrin. 146. The pharmaceutical composition of any one of embodiments 143-145, wherein the first health-associated *Propionibacterium* microbe and the second health-associated *Propionibacterium* microbe collectively produce less than about one micromolar porphyrin. 147. The pharmaceutical composition of any one of embodiments 143-146, wherein at least one of the first health-associated *Propionibacterium* microbe and the second health-associated *Propionibacterium* microbe produce less than about 200 nM porphyrin. 148. The pharmaceutical composition of any one of embodiments 143-146, wherein at least one of the first health-associated *Propionibacterium* microbe and the second health-associated *Propionibacterium* microbe produce less than about 100 nM porphyrin. 149. The pharmaceutical composition of any one of embodiments 143-148, wherein the first health-associated *Propionibacterium* microbe and the second health-associated *Propionibacterium* microbe collectively produce less than about 100 nM porphyrin. 150. The pharmaceutical composition of any one of embodiments 143-149, wherein at least one of the first health-associated *Propionibacterium* microbe and the second health-associated *Propionibacterium* microbe produce less than about one micromolar porphyrin in situ. 151. The pharmaceutical composition of any one of embodiments 143-150, wherein at least one of the first health-associated *Propionibacterium* microbe and the second health-associated *Propionibacterium* microbe produce less than about one micromolar porphyrin in vitro. 152. The pharmaceutical composition of any one of embodiments 143-151, wherein at least the first health-associated *Propionibacterium* microbe comprises a strain of *Propionibacterium acnes, Propionibacterium granulosum, Propionibacterium avidum*, or *Propionibacterium acnes* subsp. *defendens*. 153. The pharmaceutical composition of any one of embodiments 143-152, wherein at least the first health-associated *Propionibacterium* microbe comprises a strain of *Propionibacterium acnes*. 154. The pharmaceutical composition of any one of embodiments 143-153, wherein at least the first health-associated *Propionibacterium* microbe comprises a *Propionibacterium acnes* of a ribotype RT1 or RT2. 155. The pharmaceutical composition of any one of embodiments 143-154, wherein at least the first health-associated *Propionibacterium* microbe: (a) comprises at least one gene encoding an ATP binding cassette transporter; (b) comprises at least one gene encoding at least one of a deoxyribose operon repressor and a type II lipase, and less than about 10% pIMPLE plasmid; or (c) lacks at least one gene encoding a DNA binding response regulator or a phosphoglycerate kinase.

EXAMPLES

The following examples are given for the purpose of illustrating various embodiments of the disclosure and are not meant to limit the present disclosure in any fashion. The present examples, along with the methods described herein are presently representative of preferred embodiments, are exemplary, and are not intended as limitations on the scope of the disclosure. Changes therein and other uses which are encompassed within the spirit of the disclosure as defined by the scope of the claims will occur to those skilled in the art.

Example 1: Identification of Health-Associated Strains

Characteristics that may predispose a particular microbe to be a health-associated microbe can be determined using samples from healthy and disease afflicted individuals, culturing the microbes from each, and performing a comparative genomic analysis. In the present example, samples were collected from individuals afflicted with acne vulgaris in order to determine health-associated *P. acnes* strains.

Microcomedone or swab samples were collected from consented adult subjects. Clonal samples were isolated by limiting dilution on plates, and then grown in 200 µL of liquid culture. Microbial DNA was isolated from 96 individual cultures. DNA was isolated using QIAgen's DNeasy Blood & Tissue kit, following the manufacturer's instructions. QIAgen's DNeasy Blood & Tissue kit, following the manufacturer's instructions. Paired-end DNA sequencing (2×300 bp) was done on an Illumina MiSeq using reagent kit v3, following the manufacturer's instructions, yielding 200,000 to 600,000 reads for each of the 96 samples. Initial analysis was performed in Illumina's Basespace Sequence Hub, all reads from each sample are aligned with a BWA Aligner to:

a. deoR;
b. *Propionibacterium acnes* ATCC 11828 (accession CP003084); or
c. pIMPLE and other reference genomes.

Figure 2:
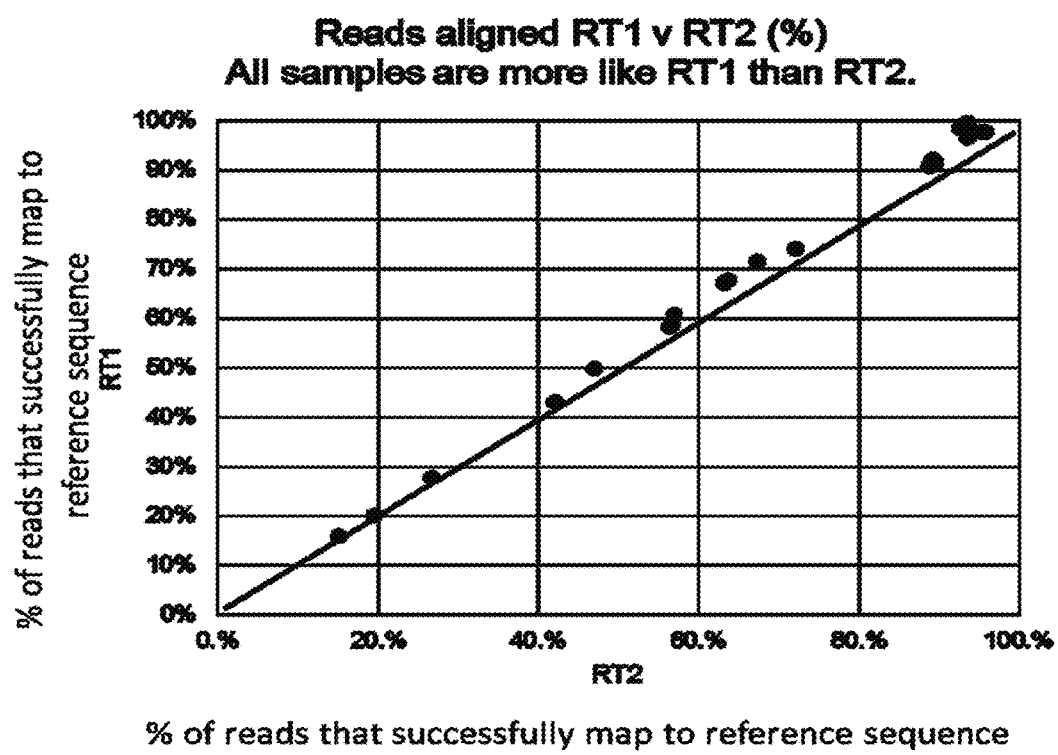
FIG. 2 shows the percentage of reads from a sample of a healthy volunteer (free of acne) that map to *P. acnes* to ribotype RT1, which are both deoR+ and type II lipase positive, versus the percentage of reads from the samples that map to *P. acnes* RT2.

Alignments were interrogated with the Broad Institute's Integrative Genomics Viewer and confirmed using Biomatter's Geneious version 9.1. All 96 clones were analyzed for the presence or absence of the deoR sequence, type I lipase or type II lipase sequence, and presence or absence of pIMPLE plasmid. Sequence alignments were performed between sequences of P. Acnes from healthy volunteers and the deoR gene. Analysis revealed that approximately half of all healthy clones were positive for deoR (greater than 0.4% of reads mapping to deoR locus). Sequence alignments were also performed between *P. acnes* of healthy volunteers and the lipase gene locus *P. acnes* were positive for type I Lipase and for type II Lipase. With regard to the pIMPLE plasmid sequence alignments of reads from healthy volunteers performed against pIMPLE-HL096PA1 (GenBank: CP003294.1), revealed *P. acnes* from healthy volunteers are free of pIMPLE plasmid. Reads from healthy volunteers map *P. acnes* to ribotype RT1. FIG. 2 corroborates this by showing that more RT1 strains are deoR positive and type II lipase positive when compare to RT2. Some results are summarized in Table 2.

TABLE 2 summary of sequencing data for the *P. acnes* isolated from healthy volunteers

|  | RT1; deoR− | RT1; deoR+; LP1 | RT1; deoR+; LP2 | RT2 | Staph. | Other | sum |
|---|---|---|---|---|---|---|---|
| reads | 112 | 160 | 42 | 1 | 7 | 48 | 370 |
| % of total | 30.3% | 43.2% | 11.4% | 0.3% | 1.9% | 13.0% |  |

RT1 = ribotype 1;
RT2 = ribotype 2;
deoR− = no deoR;
deoR+ = deoR;
LP1 = type I;
Lipase;
PL2 = type II lipase;
Staph = Staphylococcus;
other *P. avidum, P. acidipropionici*, or *Staphylococcus*

Example 2: Identification of Health-Associated Strains with Hyaluronidase Genes

Health-associated *P. acnes* clones that were RT1 or RT2 positive were further examined for presence of a gene encoding hyaluronidase. Unexpectedly most health-associated strains that were positive for Type II lipase also possessed a hyaluronidase gene. See Table 3.

TABLE 3

Hyaluronidase presence in health-associated *P. acnes* strains also positive for type II lipase

| Clone | Ribotype | Hyaluronidase |
|---|---|---|
| 1 | RT1; deoR+; L2 | Yes |
| 2 | RT1; deoR+; L2 | Yes |
| 3 | RT1; deoR+; L2 | Yes |
| 4 | RT1; deoR+; L2 | Yes |
| 5 | RT1; deoR+; L2 | Yes |
| 6 | RT1; deoR+; L1 | No |
| 7 | RT1; deoR+; L2 | Yes |
| 8 | RT1; deoR+; L2 | Yes |
| 9 | RT1; deoR+; L2 | Yes |
| 10 | RT1; deoR+; L2 | Yes |
| 11 | RT1; deoR+; L2 | Yes |
| 12 | RT2 | Yes |
| 13 | RT2 | Yes |
| 14 | RT2 | Yes |
| 15 | RT2 | Yes |

RT1 = Ribotype 1;
RT2 = Ribotype 2;
L1—Lipase type I;
L2 = Lipase type 2;
Deor+ = DeoRepressor positive Example 3: *P. Acnes* Viability Assay Viability of *P. acnes* was assessed each week over two months of storage as shown in Table 4. At least three samples were tested at each time point.

TABLE 4

Assessed *P. acnes* storage conditions

| Solution | Temperature |
|---|---|
| 25% glycerol in water | 4° C. |
| 50% glycerol in water | 4° C. |
| 25% glycerol in 75% PBS | 4° C. |
| 25% glycerol in water | −20° C. |
| 50% glycerol in water | −20° C. |
| 25% glycerol in water | −80° C. |

Samples were prepared according to the following:

1. *P. acnes* of ribotypes RT1 (HP3A11) and RT2 (HP5G4) were started at 0.066 OD600 and grown to ~1.0 OD600 in exponential phase in reinforced clostridial medium (RCM).

2. A day later, cultures displayed a dense turbidity, and they were split 1:2 with RCM to produce four liquid culture (LC) samples of each ribotype: 4 RT2 LC and 4 RT1 LC.

3. Two days later, resulting pellets and media were separated. The media of the LC was split between two tubes (~3 ml), and tubes were filled with 9 ml fresh media and vortexed. Pellets remained in original test tubes and were resuspended by pipetting with 8 ml fresh RCM. All LC (the 8 pellet LCs (4 RT1 and 4RT2), and 16 media-derived LCs) were placed into a jar with two sachets given a large quantity of oxygen filled the jar.

4. LCs were vortexed, split and fed fresh media as they became very turbid and large pellets formed.

5. A day before the experiment, cultures were vortexed, split, spun down at 4,300 g for 5 minutes, and media replaced.

6. On the day of initiating storage: LCs were split into sterile 50 ml conical tube (e.g., 50 ml aliquots of RT1 or RT2), avoiding the pelleted cells. Conical tubes were vortexed lightly and OD600 measured. Optionally, LCs may be diluted if OD600 is greater than 1.0.

7. LCs were split into aliquots and spun down at 4,000 rcf for 5 minutes. Media was discarded and pellets washed with 5 ml 25% v/v glycerol/water to wash the cells. Cells were centrifuged once more, and wash solution discarded.

8. Cells were added to 8.75 ml 25% glycerol in water, 6 ml 50% glycerol in water or 3.25 ml 25% glycerol in PBS to produce live bacteria solutions.

9. 250 microliters of live bacteria solutions were added to 1.5 ml eppendorf tubes, and placed at 4° C., −20° C. or −80° C.

Cell viability was assessed according to the following:

1. At each time point, Eppendorf tubes were selected from each treatment, and allowed to come to room temperature. Tubes were inverted six times.

2. 20 microliters of the thawed stocks were serially diluted in 96 well plates with RCM.

3. Thawed stocks were also spotted on Brucella plates at various dilutions.

4. Plates were imaged with a digital camera, and cells counted with 95% Confidence Interval.

Figure 3:
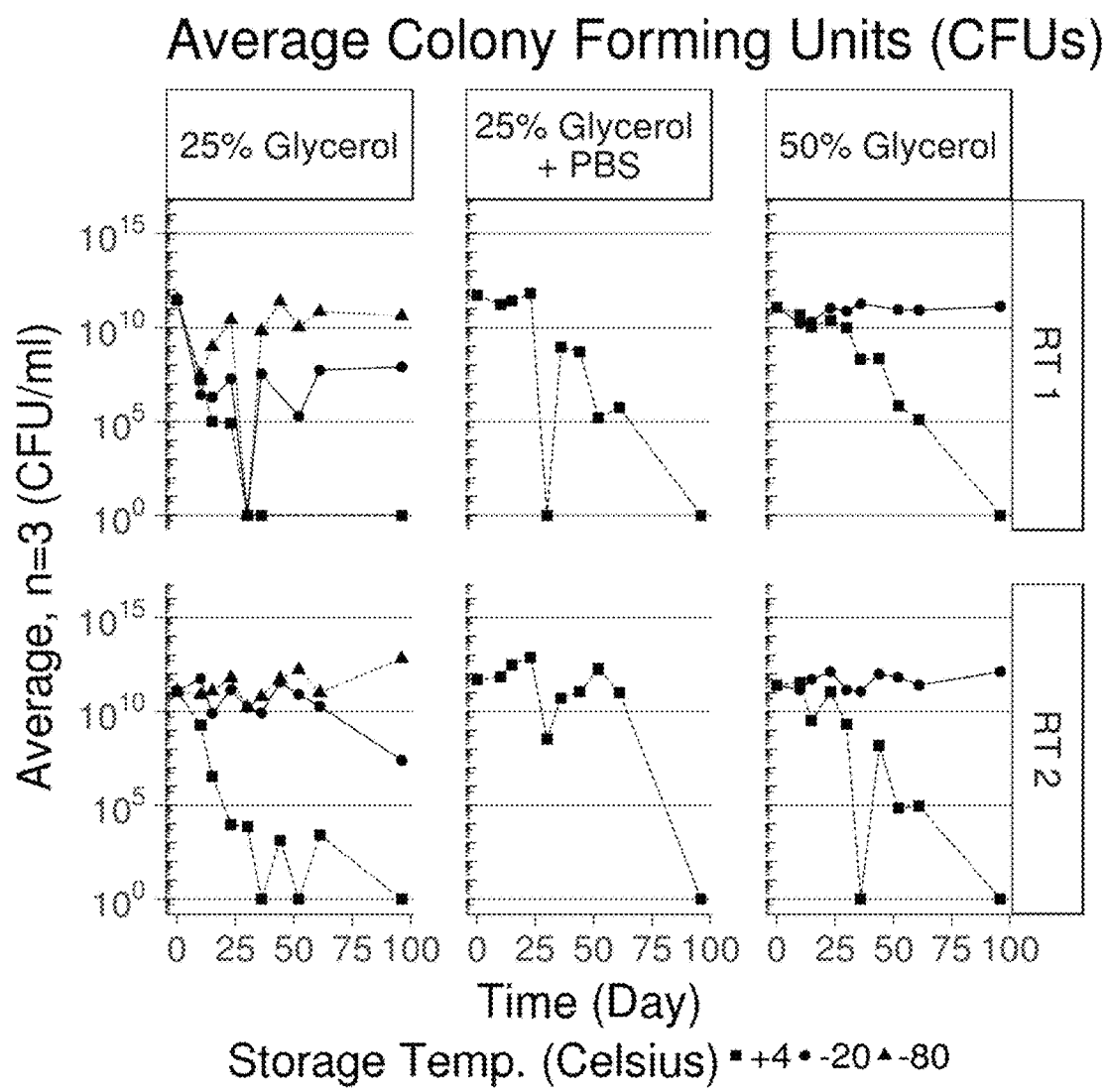
FIG. 3 shows results of an assay for *P. acnes* viability under different preservation conditions.

FIG. 3 shows the viability of a variety of Ribotype 1 and Ribotype 2 *P. acnes* preparations after 30 days, 60 days and 90 days of preservation. Heat shock of a sample, simulating direct application to skin, demonstrated that these samples would retain reported viability if used for acne treatment.

Example 4. Identification of *P. acnes* RT6

In an effort to isolate and purify health-associated strains of *P. acnes*, (e.g., strains associated with acne) it may be useful to identify undesirable strains of *P. acnes* in a sample (e.g., strains found on skin of subjects with acne). For instance, in some cases, *P. acnes* of ribotype RT6 is undesirable. To this end, genes can be identified that are specific to strains of interest. The following example demonstrates how this can be performed.

Identities of genes that distinguish *P. acnes* of ribotype RT6 from healthy strains were confirmed. Genes encoding DNA binding response regulator and phosphoglycerate kinase were identified in *P. acnes* of ribotype RT6, but not RT1, RT2, RT3, RT4 and RT5. In addition a gene encoding ABC transporter is absent in RT6, but present in RT1, RT2, RT3, RT4 and RT5. Sequences for these genes are provided as SEQ ID NOS: 6 (ABC transporter), 7 (DNA binding response regulator), and 9 (phosphoglycerate kinase)

The presence or absence of these genes was confirmed by sequence alignment using BLAST, Megablast, (a registered trademark of the National Library of Medicine) either the whole complete genome or all of the scaffolds of a completed genome against each of these three gene sequences; the results are shown in Table 5. "Y" is a perfect match for the entire sequence OR>60 bp continuous perfect sequence alignment. "N" means there is <60 bp perfect alignment. The best match of a "N" was 26 bp.

TABLE 5

Characterization of exemplary P. acnes strains

| Strain Name | Ribotype | recA type | ABC transporter | DNA binding response regulator | Phosphoglycerate kinase |
|---|---|---|---|---|---|
| HL002PA2 | 1 | IA | Y | N | N |
| HL025PA1 | 1 | IB | Y | N | N |
| HL030PA1 | 1 | IB | Y | N | N |
| HL050PA2 | 1 | II | Y | N | N |
| HL096PA3 | 1 | IA | Y | N | N |
| HP3A11 | 1 | IB | Y | N | N |
| HP3B4 | 1 |  | Y | N | N |
| KPA171202 | 1 | IB | Y | N | N |
| ATCC 11828 | 2 | II | Y | N | N |
| HL001PA1 | 2 | II | Y | N | N |
| HL103PA1 | 2 | II | Y | N | N |
| HP4G1 | 2 | II | Y | N | N |
| HP5G4 | 2 | II | Y | N | N |
| HL002PA1 | 3 | IB | Y | N | N |
| HL005PA1 | 4 | IA | Y | N | N |
| HL007PA1 | 4 | IA | Y | N | N |
| HL038PA1 | 4 | IA | Y | N | N |
| HL045PA1 | 4 | IA | Y | N | N |
| HL053PA1 | 4 | IA | Y | N | N |
| HL056PA1 | 4 | IA | Y | N | N |
| HL074PA1 | 4 | IA | Y | N | N |
| HL099PA1 | 4 | IA | Y | N | N |
| HL043PA1 | 5 | IA | Y | N | N |
| HL043PA2 | 5 | IA | Y | N | N |
| HL072PA1 | 5 | IA | Y | N | N |
| HL072PA2 | 5 | IA | Y | N | N |
| HL096PA1 | 5 | IA | Y | N | N |
| HL096PA2 | 5 | IA | Y | N | N |
| HL097PA1 | 5 | IC | Y | N | N |
| PRP-38 | 5 | IC | Y | N | N |
| HL110PA3 | 6 | II | N | Y | Y |
| HL110PA4 | 6 | II | N | Y | Y |

Example 5. Pan Bacterial Assay to Characterize Skin Microbiome

Robust pan-sampling of the skin microbiome is demonstrated in the following example. This can be performed with or without the use of preservatives. This method is compatible with qPCR analysis and does not require DNA purification. TaqMan qPCR assays were used to quantitate most bacteria collected from the face. Performance was confirmed with two different bacterial phyla, all *Propionibacterium* and *Staphylococcus*. This method required the assessment of only a single locus to recognize most bacteria commonly found on the face (*P. acnes* strains and *Staphylococcus*), whereas current methods in the field use multiple primer pairs to achieve similar coverage. The majority of the bacteria on the skin of a subject's face is described in the following Table 6.

TABLE 6

Bacteria on Human Facial Skin

|  | P. acnes | P. avidum | S. epidermidis | S. aureus |
|---|---|---|---|---|
| Kingdom | Bacteria | Bacteria | Bacteria | Bacteria |
| Phylum | Actinobacteria | Actinobacteria | Firmicutes Bacilli | Firmicutes Bacilli |
| Order | Actinomycetales | Actinomycetales | Bacillales | Bacillales |
| Family | Propionibacteriaceae | Propionibacteriaceae | Staphylococcaceae | Staphylococcaceae |
| Genus | *Propionibacterium* | *Propionibacterium* | *Staphylococcus* | *Staphylococcus* |
| Species | *P. acnes* | *P. avidum* | *S. epidermidis* | *S. aureus* |

A portion of a 23S sequence from bacteria commonly found on the human face was aligned with known sequences, see FIG. 4, and SEQ ID NOs: 33 to 43. Despite two Single Nucleotide Polymorphisms at this loci (denoted by bold and underlined letters), careful placement of primers (gray and black) and TaqMan reporter (white) enable quantification of widely diverse bacteria from both Actinobacteria and Firmicutes.

Figure 5:
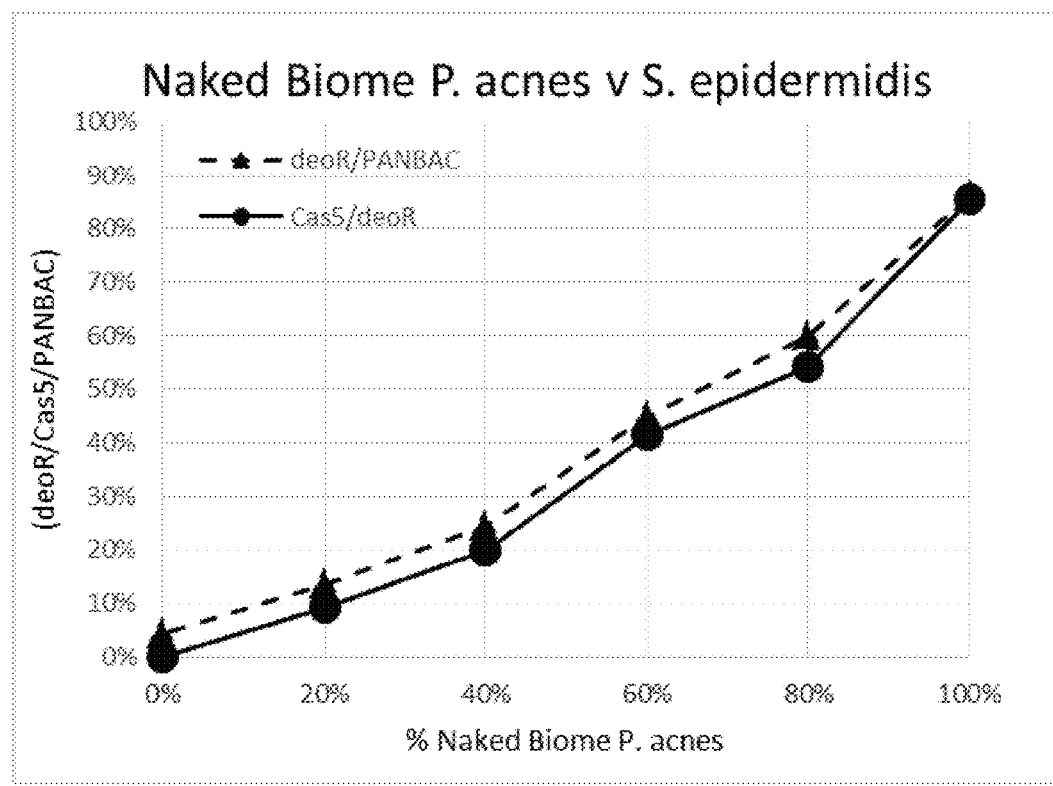
FIG. 5 shows a standard curve generated with serial dilutions of a combination of health-associated *P. acnes* and *S. epidermidis* that can be used to quantitate a percentage of health-associated *P. acnes* in a collected sample.

A standard curve for all assays was generated with *P. acnes*. Percentages of health-associated *P. acnes* were computed using a dilution series with *S. epidermidis* or pathogenic *P. acnes* which were used to quantitate a percentage of health-associated *P. acnes* in a collected sample. These percentages were determined by measuring deoR+ or Cas5+ bacteria in the overall sample of bacteria (PANBAC), see, e.g., FIG. 5.

Example 6. Determination of Percentage of pIMPLE Plasmid

The percentage of pIMPLE plasmid was determined from biological samples.

Biological samples were collected and grown in 200 μL of liquid culture. DNA was isolated using QIAgen's DNeasy Blood & Tissue kit, following the manufacturer's instructions. Paired-end DNA sequencing (2×300 bp) was done on an Illumina MiSeq using reagent kit v3, following the manufacturer's instructions, yielding 200,000 to 600,000 reads for each sample. Initial analysis was performed in Illumina's Basespace Sequence Hub, all reads from each sample are aligned with a BWA Aligner to pIMPLE. Alignments were interrogated with the Broad Institute's Integrative Genomics Viewer and confirmed using Biomatter's Geneious version 9.1.

The percentage of pIMPLE was determined by the percentage of total sequencing reads that aligned to pIMPLE plasmid from HL096PA1. The percentage of pIMPLE was also calculated as the coverage*copy number. Using these methods, the percentage of pIMPLE in the different ribotypes was determined as seen in Table 7.

TABLE 7

Presence of pIMPLE plasmid in different *P. acnes* strains.

| Ribotype | Strain | % pIMPLE |
|---|---|---|
| 1 | HP3A11 | 0.23% |
| 1 | HP3A11 | 0.24% |
| 2 | HP5G4 | 0.26% |
| 2 | HP5G4 | 0.24% |
| 2 | HP4G1 | 0.26% |
| 2 | HP4G1 | 0.25% |

TABLE 7-continued

Presence of pIMPLE plasmid in different *P. acnes* strains.

| Ribotype | Strain | % pIMPLE |
|---|---|---|
| 4 | HL045PA1 | 3.62% |
| 4 | HL045PA1 | 3.22% |
| 5 | HL043PA1 | 4.32% |
| 5 | HL043PA1 | 3.75% |
| 6 | HL110PA3 | 12.94% |
| 6 | HL110PA3 | 12.59% |
| 6 | HL110PA4 | 13.19% |
| 6 | HL110PA4 | 14.06% |

Example 7. Genetic Modification of P. *Acnes*

In order to improve healthy *P. acnes* clones, the expression of a gene in the porphyrin synthetic pathway was knocked out. This was accomplished by inserting stop codons in the middle of the open reading frame of the gene HemY (protoporphyrinogen oxidase, EC:1.3.3.4 1.3.3.15) in the *P. acnes* genome. Briefly, the RNA-guided DNA endonuclease Cas9 (CRISPR associated protein 9) was targeted to HemY with specific CRISPR RNA (crRNA), and trans-activating RNA (tracrRNA) cleaving a double stranded break at the desired location in the HemY gene. A specific sequence was inserted at the site of the cleavage with a Homology Directed Repair cassette (HDR).

The Cas9, crRNA, tracrRNA, and HDR donor template were introduced into *P. acnes* using electroporation to transform the cells. Cells must be electrocompetent before undergoing electroporation. Electrocompetent *P. acnes* were prepared by growing them to stationary phase and washing them in a buffer of sucrose, magnesium chloride, and monosodium phosphate.

The tracrRNA and crRNA were duplexed using IDT's duplex-forming buffer. Then the tracrRNA:crRNA duplex was incubated in a solution of Cas9 and phosphate-buffered saline, forming the ribonucleoprotein (RNP) complex. The RNPs, HDR, and electrocompetent *P. acnes* were combined, incubated on ice (transformation culture) and transferred to a pre-chilled BioRAD electroporation cuvette. The transformation culture was electroporated using a BioRAD Micropulser. Rich *clostridium* medium was immediately added to the transformation culture and transferred to separate container for a 24 hour, room temperature incubation. The transformation culture was evaluated with qPCR (see FIG. 6) and spread out over multiple Brucella plates for a final 72 hour anaerobic incubation at 37° C.

Figure 6:
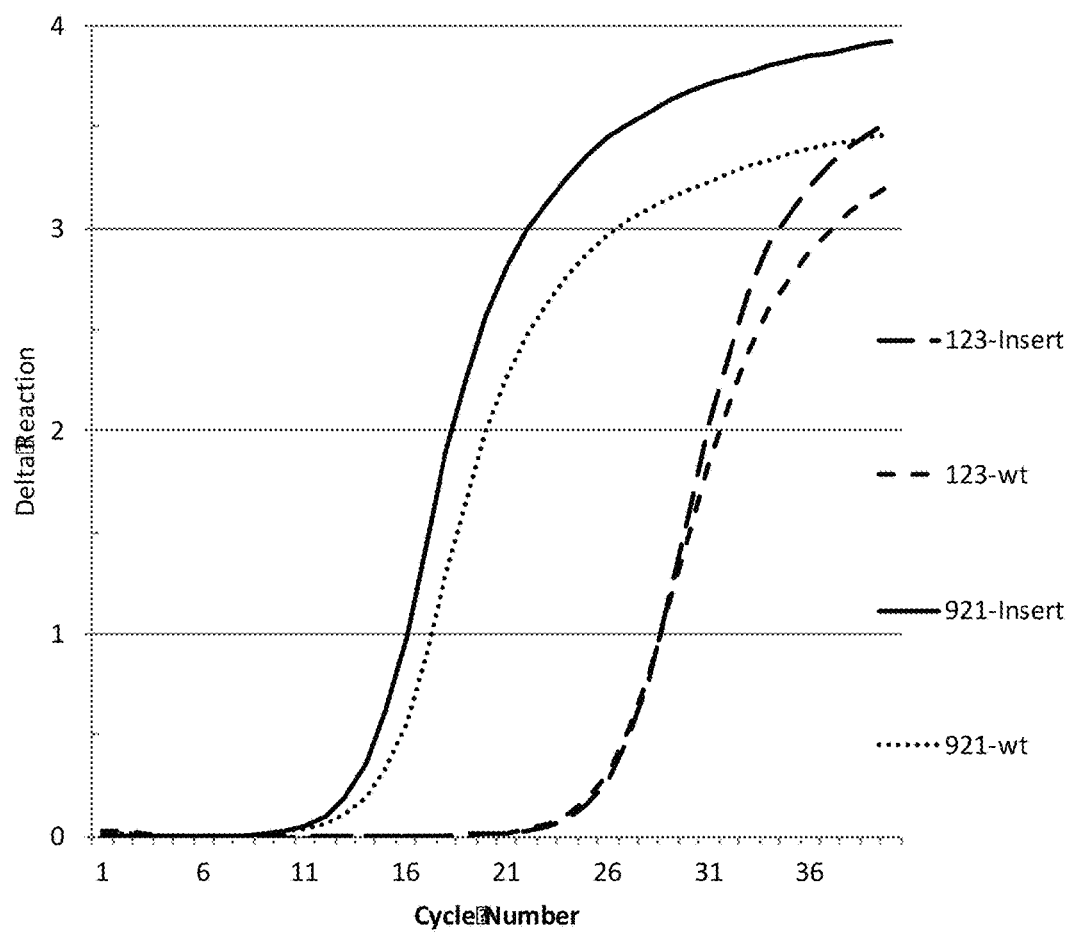
FIG. 6 shows qPCR of successful CRISPR editing in *P. acnes*.

FIG. 6 compares a qPCR result from cells transformed with a 921 bp (921) or a 123 bp HDR. Each sample was evaluated with primers that recognized either the inserted sequence (Insert) or the untransformed or wild-type (wt) genomic sequence. Note, using the longer, 921 bp, HDR transformed a greater percentage of the cells. The '921' sample had more cells resulting the leftward shift of both Insert and wt lines.

Example 8. Packaging Compositions of Bacteria as Swabs for Topical Application

A packaging system was created to store and deliver therapeutically effective doses of pharmaceutical probiotic compositions disclosed herein to the human face. These devices need to safely store and deliver approximately 4 milliliters of *P. acnes* in a pharmaceutically acceptable excipient, anaerobically. Furthermore, these systems were amenable to storage at temperatures as low as −80° C. The packaging system prevented contamination of both the probiotic (by the environment) and the environment (by the probiotic), minimize exposure to any air, and enable easy application.

Figure 8:
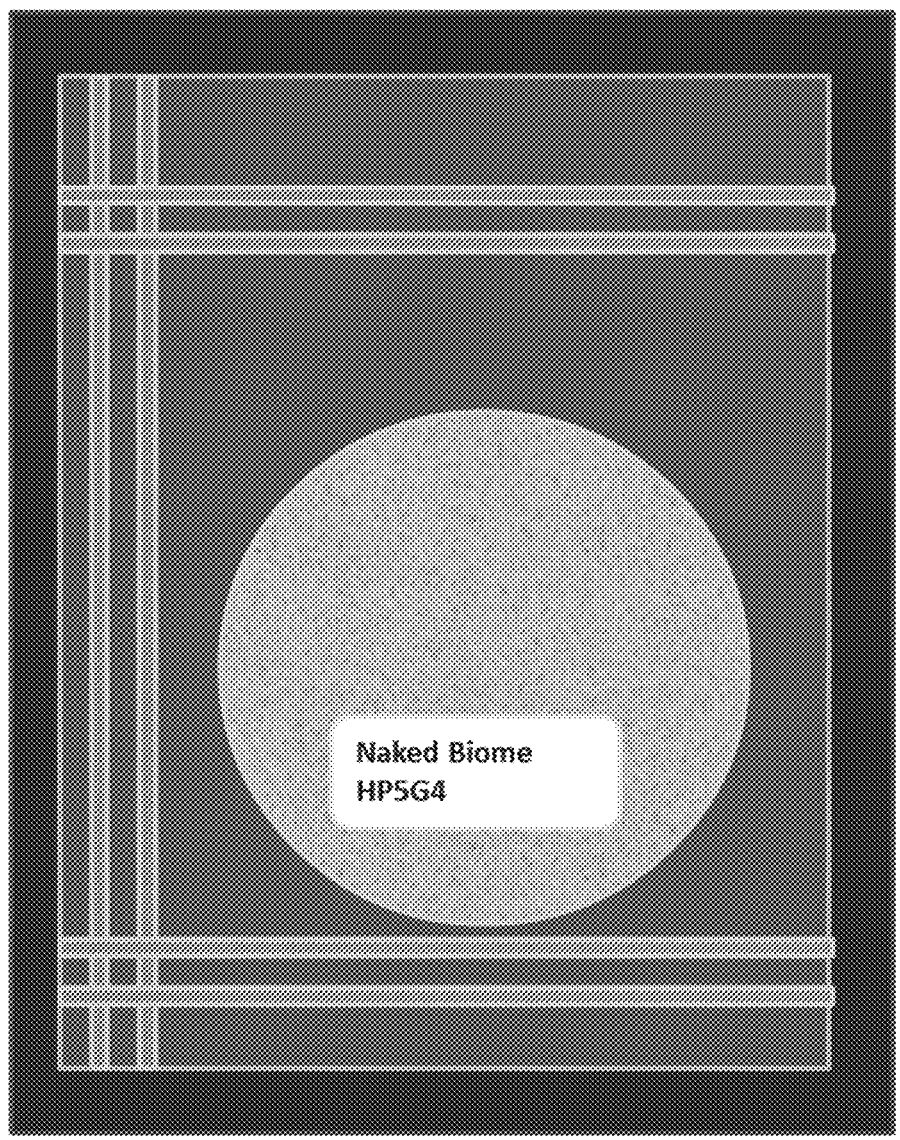
FIG. 8 shows exemplary packaging for compositions disclosed herein.
Figure 9:
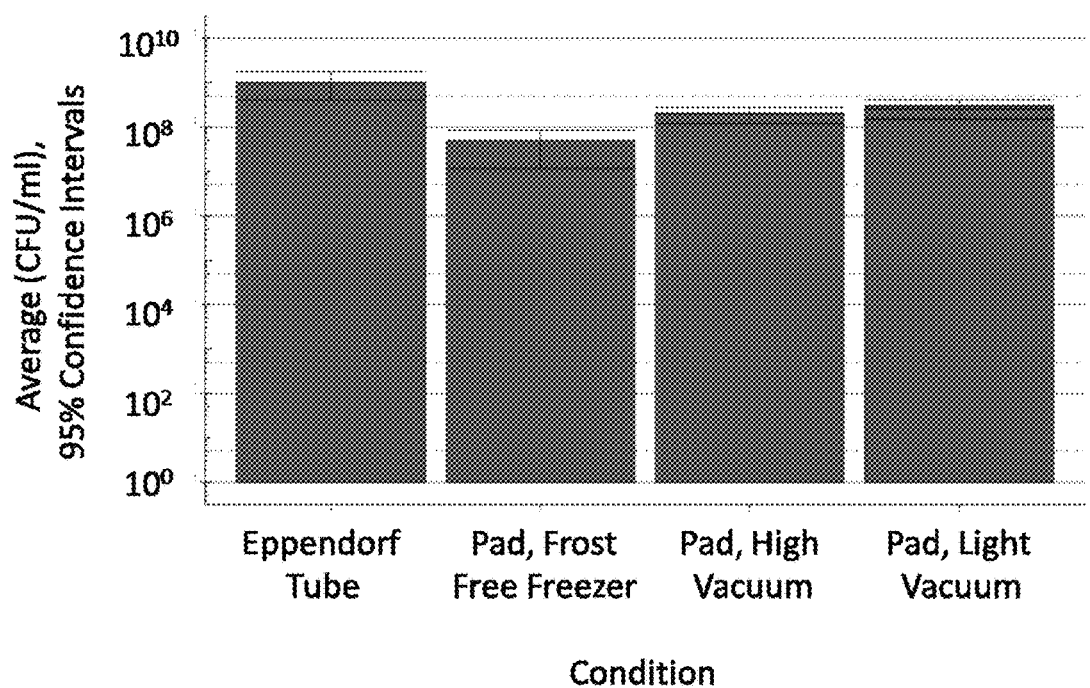
FIG. 9 shows bacteria viability of composition disclosed herein after being packaged under several conditions.

An example of an aforementioned package is shown in FIG. 8. Briefly an approximately 2 inch diameter circular cotton pad was placed in a laminated polypropylene bag. Three to five milliliters of *P. acnes* solution, at ~$10^9$ microbes per milliliter, was aseptically applied to the cotton pad. Almost all of the air was evacuated, and the bag was thermally sealed in a chamber vacuum sealer (Vacmaster VP215). These packages were easily opened and the pad removed for application of the probiotic or measurement of recovery and viability. Near quantitative aseptic recovery was achieved by centrifugation of the pad in a 15 milliliter conical tube. To confirm that the cotton pad, polypropylene bags and high vacuum do not compromise viability of *P. acnes*, or retain *P. acnes*, samples were collected from four different conditions and determined CFUs/milliliter by plating and counting colonies. FIG. 9 compares recovery from *P. acnes* samples stored for one week at −20° C. in either an Eppendorf tube (control), or in our packaging in a residential frost free freezer, a laboratory freezer or in the lab freezer with only a light vacuum before sealing. Large numbers of viable *P. acnes* were recovered from all conditions.

Alternative types of pads and bags could be employed for such packaging. For example, if a polyester pad is used, heat sealing could affix the pad to one side of the bag providing a shield and handle to enable application of the liquid therapeutic without mess and exposure to the hand. Similarly if a peel-open pouch is used, scissors would not be necessary for clean easy application.

While preferred embodiments of the present invention have been shown and described herein, it will be obvious to those skilled in the art that such embodiments are provided by way of example only. Numerous variations, changes, and substitutions will now occur to those skilled in the art without departing from the invention. It should be understood that various alternatives to the embodiments of the invention described herein may be employed in practicing the invention.

SEQUENCE LISTING (434 sequences)

SEQ ID NO: 1 - DNA, 1019 bp, Propionibacterium acnes
gggacagcgaccggtgaagggtccgctgggagcaaggggatcgtcagtcggtgtctgcaggctgaaggggcgcttggatgacgtggtgtccgctccggcggaaggcaccgagcttctcgctcagctcactgttcgacgactggacggtgacgatccccgtccggggcggtatcgatgcccaatatggttcgctaccggtggtgaggatcttggtgggatcagcgaggatccacgacgtgcgagcccgcgtcatcgcttcgtgtttgaactcgacggactccaggagtgggcagttgagcccgtcggtcgcagagactgcgtcgcagccgatgaacgcgacatcaggggtgatgctgcgcaggtttgatgacgcccacggtcccagaaggcttccgctgtgctgccttaacgccccgccgagcaccatgacgttggcggtgccttcggccacggcctggagcacggacaggccgcctacgaggatggtgatgtcgttacgagtcgacagaaggcggcccagtgctgcggtggacgttccggaatcgagcagaactaggtcactctcgttcacgaggtgtttggcggcatatgtggccattgctgccttggagacgtgctcgcattgttccttctcgtgccaggtaggctcgtgtcgtcggatcatgacgtctcccccggaaatcttccagatcttggattcatccgagagggcatcgacatcgcggcgaatcgtcgatgtagagacaccgaacagttgggaaagatctccgatggactccgagtgccccaaagaacgcagatggtcgacaatgtgtcggcgtcgggcagctgtcgccgtgcgcggctgtttgggtgttgtgctcatggtgtcttgatcggtgacgtggtttggctgatccaatttgaggaccgcctctaaggataacccagcggcatcactgctggactcggtctgtttgggtggtcggtccaagaatttctcaggtcacaggctaataaggttacctcgtcggtgcact

SEQ ID NO: 2 - DNA, 55585 bp, Propionibacterium acnes
tgccgacgccttcggcgtcgggtgagcgcgtggataggcgccccttcggggcacctgtaagcctgtatcgctgcggtttacagccttggccacccaaaggggcagcaaggggcccggagggggcattctgcgccgctgatagcatctcacatgtgagttattctctcaactatccttcaagtcaagcgtattagattatttatctagtactcttgacagtccgtctatcgggctatatatttataagcagaacgagagatcgggaaaggaatcaacgatgaagtacaccgcacacgtcaacatggtgaccaagccctacatcggacttcccactacccgaaccccctacaccctcgtcgacgccgactgggccacaacatggatgatcgacgaaacctacgaagcccactaccacggcaccagcgtggagatcagcatctacggcgaaggccccaactgctccgtactcaccaaccgcatctacaccgaccagcccaccgatgtgaccgctgcactcgccaactacggcttcaccatcgacaccaccaacacatccaaaaccatcctcacgctcacccgcacagccaccatctcccacctactagccatcctcgatggcctaccccaagccgaggggactcactggctcaacactcaacccgacctccaccacatcaccctcgacgactccaccaccggctgggccaccaaccgcaccgacgacaccgacaccggcgtctgctacgacaccagcacccacaactggcagatctgctgacagcataacgggcctgcccttgaagggttggactctgcacccatttcagccgggtacgttgccggctgggcgaaggaagcagacggcgccgcgattgaagctgccgccgagcacgtcgcgaagacctcccacgcgattgccgaggcgttgcagctcaccgcacagtgagccccacggggcgaccggctcaccccggtcgcccctcaccccccgacaggggaaccgttcccgccgcctgaatctccatacccctgatacgtactacgcggggtcgaggagtggactcccccaccctcgtgtagtacactatactacacagtcattgaggatagaggtgacgtcatgagtttttcgatccgtttaaccgaccatgagcgccgcttagctgattcctacgcccgcctgcactcgcagtccctgagtgaggctttcaagcaagccctcttcgaccgcatcgccgacgagttcgatctgcaagtagcccgtgaggcactcaccgactacgcccgcgacaactaccagtctcgccccatcagcgagctatgggacgagtgtgacctatgagctggcagatcgaaaccacgagccggttcgataaagaattcaaaaagctagaccgctacacccaaaaactcattcacggctggatcacgaaaaacatcgacaacaccgacgatccccgccgccacggcaagcccctcaccggtgatctttccggactgtggcgctaccgcatcggcgactaccgcctcatctgcacactcaacgataaccgcctcaccatcctcgccctgtccatcggtcaccgccgcgacatctaccgataagccgttgcaagactgcggcgtcgacaccgccgggaccctggcccaggccttgggcctggaggaggacgagagcgaggagcacgccgcctgagcggtcgccggcacttcccataacagcaccggtcccggcggcccggccccgcgtctggtgctcggaccgatgccggcgcctggcctccgacgcccgccggggccagcggctgggctacctcgacgtcgacgtacaacgggccgaacgaaccgtgcgctgatttaccaccgcttccgcacagagaacatgcctctgactaggagaaatgacgttttccacagggcctctattactaatatccctattatctctatccacgcgcgcgagcctcagcgttcaagcttcaggtcttgctcgtctccctcgcgcctcgctgcgctcgttgctactgccgccccacccggcaagccgggtgggttgccatcggaataccgtggaccatcccggcgcatacacccagacggtccaagatccaatccacgctcacccgcgacgccgctaacgatcctcatacaccgtagatgccgttctgagagccttccagacccgcacgtgggtttattgcaccgagacccaaatcccctcagaagcgatcctgaaaccgtctacgccccatttccgacggacgctggacaggctgggcggcttgtctcccgccgcagacatggccctggcatatgcggttgccgactggtgggatcagggattggatcacacggcagacggctggtccaaggcgggtgtgcaggtgcggtgagcggcagacgtgaccggtggggtgcactgtcatggccgggcatctgccgagccaccatgcgggccctggaccaggaggcagcccgctgcgaggactgggggaagacggcggcacggatgggccgtcgggatgcggcggccgaattcaccgagactgcggtgcagcatcgtggacagatgcaccacctcatgtcggcacaaaaagtgtgggtgtcgaccgacatggtgtcggctacactggacgccgcaggagacgtgccgagtttcgaggccgtcgacgtccctgccgccgggctcatgggtttggccagccccctgccgccggttaccctgcagcatccgctgtatctgcgcagcgacgagggtgtgacaaccttcactgatccggttctcgtcgacgcgctgggatggtggatggattctgggcgtgtgcacgtggtgatgtgcacacgcacaccccggctgcccaacccggtttatgcggtggcctccccactgacggtggtggagaaaatcacggtgcccaccggcatcgagttcgagaccatggagtccaggatcctgacccccggcggcgtgacaggcgtctcacggcagggcacacgcatgatgatccggttggcgtcatggctgggtgccgcgtgggtgctcatggcgactccgacggtgtcggagccgcaccctatggatggccggtggggaggcccagcaacggggcagacccggccgcgtgatcgggtgaccgtggtcgacatgcggcccatgaggcaggtgcacaccaccaccgaccccaccggcaggcggttgacgacccggcatgtcgtgcgaggacactggacacaccaaccctacggcccggcccgcagtctccgacgcctgcagtgggtcgccccattcatccgcggccccgaaggggctccgttcgtcggcaccgacaccgtcaccgtatggcgccgctagatacgcgggcgcggggggttgacgaacgatgcccccctctttgtgttgtgatcagtcgtgatcggcgggttttaggtcggggtaggtgtcgagaatggccttgaggacgaggtcttggattgtggtgtcattctgggctgccttgaccttcagtccaacgccgatgtcccgggggattctggtctgcaacttgaacaggtctgcctccttggttttgaacagtttggctgcagggttggcaacgggctgttcttggcgctggcgtccaaggttgcttttctttcgggcggtcatgacatcatctccaacagttcgtcggcaacatcggcgaagaaggcgatagtttccggctcaggggtacagccgtaggcgcgcttgatgacttgacgcttggggatgacgtgatcgaccaactgcgtctgggagtcgttggctagaaggtcgcgaccttccttgaacagggaggtattcggttcagctttggaaagcagcaccacgcgcggggttcctgcggcggcgtcgtgcgtctcccaggtgcgcgccatgtcgagcccggacgtgtcggtggggatgataaccagatcggcggcgcgaatggcggcggtgatgatgtcaccgttgcccggcggggtgtcaatgatgacaacttcttcgggtccggcgacgaggtgctggagcgtcgccttgttggccggttccacggggaaccccaaggggtcggcgttactcagtgtgcactcggcccaggatgatgctgacccttgagggtcggcatctttgacgcggaccatacggcccgtctcatggagagctgcagccagcaggatcgctgccgtggtcttaccgacgccacccttggcgttgataatgctccagatcatggtgacacctttcagtgaggatgcatatcagtttacctgcaaggagtaaagacggcaagcagttatgccgtttctgcggcaagccgtcttgcatccttggatgtatagatagttgtctacttatggttgtggatcgtggtgtctcgtaccaggatttagtgtgctcgctgatatgcacgactttcgggcggcctgatctggcggtggtgccactaacccaggagtctgatccgcaaggtgtcctcgactttgaggaaggggtctctgctttcgtgttgacctaaagtcaacggccctgggcgatcactgaatcctaataactttgtatccttccctgattgcatcttagcatccttgaattcaaacagggatggagccatgctgttttgacgacatggatgcactggggtttggttgttgccgatgcggagcgtcaggcggcccgggacgccgccaccgccgacacgctgcgggagatcgtgggactgctgggccggggcggcgaggtcccgcccgccaagacggggcgtaagacgaccggcaggccggccccggcccgcaagtcgtcggccacgcagtaaaggcagggatccgtccctacgcagagagcggaggcagatcctgggggatccgactcttcggttccgtgatcttcccggagatcttcccggatcccccagggctcatcctgatacggggtccgccgacggaccccgtatcagtgggggcgctgccaccagtgatggcgggcgggtcggtcggcgtctaggccccgcccgatggtcgcctggtctacctcgcaggcccgtgctgttgccgaggccgagaacgtctgcccacttgttgccgattcagtcccctctccgtctgccatgtcgccaacctttcctatctggcgtgctcatggacatgcccgggcacgccctcgctgctcagaggcctgctcgttccacctctggccgcgaaccgtatttctgctgaccactcctcgtgcgtgaatatttgccagccttggccattcatatttggactactctgcaccagatatcggactgggaaacctcttgcacatctctaattgtcatctattcgttgggcgcgcgctgttagatcgtgatcataccaatcagaagacaaagcgacgcccttttgagcggcttttcgaacgattctagaccgcgctatatcagcatttctaccgcgcggccagagtgctacactaaattcctctctgcaatccttaagtccattctttacttcctcatccaatttctgcgacagcatttttatggaagcatcgcactctgactcatcatcaaatgcctcaattgcgtgcgttcgccattcacggcgcgtattatcgtagccgtaatgaagtattacccaccgatccacagaatcatcgttaggatctacaactgtcatgaatggcccaactctcgctctggtgtattctcaattgcagttcagtgactttacttgaccagtcccggatttagtagacgtagacggagagtaccccgccgggaacttgactgacatcactgctgtaccgtactgctttcccgggtggcaaccatcgtaagcagcatttgccgtgacgtacctagtgctctttctctgagtgccggtaatcgccttatatggtacaggtgggtgaatcgtagccgttacggctaccgatgacacgtttgcatcacatgaagctgtggcgacataattagttgtcccattgacatgatgagagtcgtggacatactgtcgaggatcgagagtgcaggttattgttgacgccgttgttctggtaccagctgctttcgagctctttgttgcagttacagtctgcggccctgaaggttttactgacgcgactgatgtgttcgcgtgttttgcggcagtgctttgatttggttgtgcttgtgtagcagttgctgatgtcgccagtgatgcccccattaccatagctgtgattatggcgtagtctttacgcttcattgcgcccccaaataagcatgttagtttgctattttgaataggaaacgagacatcgccatgacttgtcaagggcagaagtagaaagaatcggggggtatcaagaaagatgtgctttcatcaggacgaaagcggatgggtccgttcgacttggtgacgaatgatccggccttgcgtcgcggagaccaggccggcgagtttgtcgagcagggccgccgtggcctcatcgtcgggcacatcactaaagggacgaacaaccatgacggctagggccagaaacgaccggaactgaatcgcatgtggacccccatctggcaccaggcacacacctaccgaccggaaaccctgcaccctgtcgctcccagttcacctcctaatatgcgcctatagtctgtgctagtagacattattttgtgtgttgtttcccatctggcatgtctggccccggacccgccgcgacacgcggtggtggataacagaccaggacccccggaccatagagaccagggggacgagacagtcccccggtgaggatgtctcgatgtgcagatcaggaacagaatcgccgggcacgacccggcgccggtgccggtgcagtgaacccgtggcccatcgactccacgaacgaacgtctcgccttcctcaactggtgttggcggcaaggctactcagcagccatcgtggaaacgatggacgccgcgggagcctacgaccacctcgacgacgaccagaccagcaaccagcacgactaacgccgctcccagcacgggggaaggcggcgcaccaggtgcgccgccttcccccgtgctggtgtctcgtcggcttactggtgggggtcgtaggggaacccgtaggtgtgttccagggccttgcggagaaggtcgttcatagttgtgtgttcggcgacggccttcatcttcagcgccgtgtgggtggcggtgggtagcttgacgttgaacgcggtgatcggggtcttggccgactggaaggtttcagagacactggctccctggctggccgccatttggtcggcgtaacggctggctttgtcggcggcggtgggtttgcggttcttactcacttcagcatctccttgattcggtcggcaacctgggcgaactctcctagatctgttggccgggttccgatggcttgccgataggcgacccgtcgatgaacctccgcatcgagaacgtctaggccctcaacggcggcggccccctcgtgggcatcacggtattgcctggtccaatcggctttgttgaagagcagggcccggcgtgtgccgtgggccacctggtaggtcattagcgctcggtccatgtccaggtcccccgactcggtcgggatgatgaccacatcggcgatgtcgagggctgcggtgatcgtctgagagtcaccggggggagtgtcgatgatgacaaggtcggcgtcgatgtcacggcagcgcctgacgataggggcattagccgggcggacctcgaagcccagcgggtcaccagtctcgaaagcgtcggtagcccatgacgtcgccgatccttgcgggtcggcgtcaagcaagatgactcggtactgagctgctaaggccgttgccaggtagaccgccgtggtcgttttcccgaccccgcccttggtgttgacaatagaaatactacgcataaatacatcattacacatgtgcatcgatgtatctgtatatatgtgtatcggcgtgttgtgagggaaaacccgggccacatacaacgatcccccagccaccacagccgggggatctctcagtaaagccagcaactcccacagaagttgcacccccacgatacccaccacatccgtgtcaagcccccacaacacccaccagcgccctaggcttcccccatgaacattgacatggacacaccaaccgaaaccgaagccgacaccttcgatgccgtcctcgccgacattaaccacatcaaccgcctcaccgccgacgaaatcgagtgctactccatgggagcctgtctcctcctcctcaaccaccaccccttctccgaactccgccaacactgggccgacaaccccaccgacgaaaccacgtggaccctctacggggccatcatcgccgcctccaccctggacccccacctcagcatcgacgccctagcccgcctctaccagctccccctcgacctcgtgacccaagccctcaccgtctaagcgtcgatgagcgggggagaggtagcgcactatcggctaaggaaccccacaaacaccaaacccttgtcactgggaagggtttggtgttatgctggtctcacaactcaacagaggaggtgagacatgggaaatgagtaccagaagtcgctcaaagtcctgttcaagaaactggaatctgagcaaggagcccgcatcgagacccggcgcaaaggatggatgatctacccgccggatacgtcacgatcagcggtcatgatccacaagactccatcagatcgcagagcatgggccaacatgctttccgaactgagacgctcaggattcaccgtctaactcagtgaagggggctggagctccagccccctttcaaccacctcccccggacaccacacaagaaaaggagaacatgatgtggcacgttcggttgtcgcttcgcgcaatcagcgaggacatgctgttcgacgccctggacaccctcgaccccttatccccggtggccacactgggccccgatgagcacaccggatcattggcggtgttcgtcgaggctgactcactgacagacgccatcgagactgcccgcacagccatcaccaacgcatgcaacaccgccaccataaccggcgtagaagcccgccccgaagacgaatgcttcgcagacgttgaccggcccctgttcccgccagtggtcggatacaccgaaatcgctgaaaccgcaggactctcacgtcagcgcatccgccagctcgcaggcaccgccgggttccccgcacctgtcatcaagaccgcggccggcccgctgtttcccaaagccgccgccgagcagtgggcgcggacacgccagcctaaggcaggccgcccaaaactccagaccaccacctcataacacatcccgtgtgctgaacctgttggccggcccagcacacacccccaggggccgggcccagcccggccccgccccacacccaaccgccccctgttgccgccgtggcgaaacgatcaggcgagccacgaccatcgccaagctgaatggagagcgagcatgagcaccacccctgccgggttcgacttcgacgctctggccgagtgggccgagagcgatgaggcgacccacaccccgcaaaccagccccgtgttccggggcaaggacgccgcgcgcgccagccgcgcattcctcggccgaggacggcccaccctcggctcagaccacgccaccggcgagggccggtcgccccgccgtcaggtacggctcgacgcacgcaccaacgcgcgactcgacgcctacgcagccgcaaccggcaccagcgcctcccagatcatccgcgacgccctcgctgactacctgcccgcctgatcccaccccaatccactcgggcgcctgtcagtgccccctcttctgggtggtggtccggggcgtcaccgccccggaccagttgggtagtcatctcagttgaaataagcgattagtgatacgcccctcatgctttccggtgctgtcatgagcgtctgacaacagcgacacctcggggcagccgacggacagtcctctggctgccgctctgatcccatgcccacggcacgaaggtgtcggacagctcggtctcgtcatgtgcccaaatagcgtcgtgggcctgtcgccaagcttctcgggagccccacacgggcacgaccgggccacaccggtgtcctggtctccagtgtcgcgacactgtcgatttcggtacgtgcaatgcggcggcggtttgacggatcgacatcccagactcccgcgcgtcccagatcgccatgtggagagtatttgcctccagtgcggccgccacacttgcacgctctcgcgcacgctcgaatgcccgcctagtgctctcaaatgtcgtcacgacgcctccccctgaaaatactcagggtgtcccacggtgggacaccctgagtatttcataccccaactcgcctcaccacacgtcgacctcgacaccgatcaagcgacccgtatcagcgacattgccgtaccgctgccccgcctggtcctccagccacgacaacgcatcccgaaacagcccgacgtcttccaaagctaaaccacagtcgtagccgcccttgtcccccaaccgcacaatctggcgctcccggtggcctccctcgtcgacctcgatccacagtttcgcgtgcatccgctggcctcggccctctgacaggatctcggtgagcaggtcggacgcctgccctcgcgcatcctcgttactgcgggggaattggagtatgtgggaggaacggtggtggggcaggtttgtgacctcgtgacgcagcaggttgcgcttgtgcatctgccgttcgagacgctcgggctgacctgttgacggggttgagccgtggcgccgcttcctcggcggggtctcgatccgttgctcttccggcggttcggcgtcaggttgtggtgcgcgatctcccctaggacgggggggctcgccacctatatccgagggacgatgagacggccttccacgcttgctgcgcactttcgcagcccgccccttgcggtcacatcgacgcggcggcggagtgacgtcctcaccgcgcgctaactgcgtcaacgccgccaccaggttggtgcccggtttcagccctttcagcacgaaccgcaccaggcgggggtctcggccgattcgtcgggcaatctcggcttggctccacccttcggctaacagggtgcgcaacaagtcttgggcccggttatcacgctcagtcactggtcgcctcctcggggagtcctgcctgctcggcctgctctgatagagcagcccgttccgatccggtctggggcgctttcaggggaccgggtaggacacctttgacacgcagtcgcccgtccttgccgtcgtcgccgcccccctgggccacagggagcgcccaggggggcacgttgctggtgtagatggcgtcgccgtggatagccagcagggtgcgggagttcatgcgtagtgctcctcccttggttgtggcgttttttccggtggtggggtcggcgatgggtgtgttgagggtgcgtacgcgggacagggcccagatacgggcggcgatttcggggtgccaggtgtcggggtcggggcggcggcgggcggtttggtattggtaggcgatggtgtcaccggttttgttgcggatgacgtcgaagccttcgatgtcggaggggatgtcgtcggcgtcgtagacgacggtggtggtgacggggttggaggccgacatttggccgatggtcacgcgcagcatgtttttcaacgcggaggtgaggattgtcgtggcggtggggttcttgtctgcccagcgtttctcggcgatgtcgatcatgtcttggatggttttgacccatcctcggatgggatcgactttggtcagtttgatccctccaaggaactcgatgggcttagtaacgggcccgtcaggaccgaattcggtgtcccagccttcgtcgatggctagtttcagttcggcggcgtcaacccatgtttcgtgggtggtgccgggcacgttgggccaaaaccatcctgctcgtcctttggtgcgtttgaccggtagtaggccgatgtcgtcccaccaggatggcacggtgaagcggatgtggtagcgggccgggtgccaggggttgttggtgaacaggtcgtgagcttcggtggcgctgagcagagtggcgggtgcggcaccgatctctccggtcactgatccggcatacatgaatcggccgtcgatgtacacgaagttagggatagggccggcaggcacggtggggcgccaaccttgttcgcggtcctcggggttgccgtcgtcgacgcatagttcgtagcggtgctgaggggaggtgtgttggatgagtgcgcccagttcggggtccatcggctccatgcgataggactcgggggtccgtagcttccagaggttgattccttctgctccggggcggtccatgagggcccagtcgcggtcgattctggtggcgatgatgtgggttaattcgcgccatgcccagcgggcctggattggggtgagggtctggccagggaaccattcatcagcgaccagaatgtcgaggttgcggtcggtttctttgtgggtgaaccggcctcgggcgggccgcccggacagcatgaacaggccccgcacgtgccagtcctggttgaactcgcgggtgtgagcgggggtgtcaggcagcagccaggattgaggctggtcggggatgttaccgcagacgatcaggcgtcgggcgttgtggtgtagcgcggttgttagcaggtctgacagggtcgcgtgcttggtgcgccgcccccctagcactggcaggatctcgtttccggccgcgtcgactccccgggcggtgtcgatgtctagccacactgtttcggggtcggggggccgatgtggggcgggacggcgctgctcctggtcgtctctcatggtttcctcctttgggccagggagcggccggcgtcgagggcgttcatgcgctcgcgttgttcttcgcgtagttggtagacccggcctcgtgacactcctgctgcctcggcgatggtggtggccggcaggtggccgatggcggcagcgtcggcaaggacgtcacgccaggccaggtcaatggttcccagctgggctagagcttcgtcgcggcggcgggtggcatcagccactacggaggcccaccctgtggggtggatggtcttgacgacgattcggttgtggcggatggggccccatgcatcagcggggacttgccagccgtgattggcggcggactcggtgatcttgaggcgtcgctcaggtgcgcgggtgcgggcagtgacgtcggtgttccaggtctggactggtacccacgtcccctctcggatgcgttcgatgacgcacgtggtgacctcgtcggtgactgtgatgaccagacgataatctttcccgtctggggtggttcggtagctgggcatgtcaccctcccctatctgtcaaatgagctagacacagtgtctatttaatttgacgcaaagtcaagtgcattagacgcctttgtgtggatccgccccaccagacaaacactcgcgcctcatgacccgccgcgaagccttaacgaaaccaaaccgcttatagaaccgctccgcagcgctccccgagggctttagctccaaggtaagaccttgctcgtcggcccattggcagacttgtgtgaggatctgtgagccgtagccctgatttcggggggcggcatgcacgcacatcagcatgtgaccatgacggcgggtcggcgggctgacataagccccaccacgccagtccggtgtgatctgccaacttcgccatgccgcagcgcgccagcggcgggcctcggtagccaccatgatcaccatgatgatggacagggttacgacgccgactatggtcagctcactccagccaggccagttcccggagatgatccagcctcccagcgcccagatgatcatggcttccacgcccgccgcaatcgggacgagtggggcagtacggatgcggcctgccatgatctcggtgatctcgctgcgatgccatgacaaggagaattcccacgactcttgaatcatgctgatgtgtgaacggcttcctcggcttcgccctgccatagcttctctagacggcgctcggctagctcgtcggggcacggcgacagcctgccgcactcggagcagaccccgaagtggcgcgagagagtgatgaccggctcatcgggagcatgaaccgattcaacgaccgggtgctgctcatcggtgagtcctgaggcgtgaccaatctcggctagacggaggtgaaccataccgtcgtagtagtcgaggccttcaacgtggaacgggtaggagccgtccgcggtgtggcctgcaaccaggtccccgacttccagctgactggcggtcatggttcgcaccggcggcagcggggtccgggtcgcgttgatcctcatggtctctccttgcttctgcgccttcatagatgaaggtgccacagccggggttgatgtgcggaaccacagccactttttcaataaatccatcaccacggtctcaccccttcccaaatgtgtaaaccgtggtttacgctttaaggcatgatcgaacacacaccgacacccgccgcgcctcgcgtggccatcatttcccctagcgggccaccacggttcttggccgagcctcccagcgccgcgctgcgacgccatggtcggacccgcatgaggtcccttcccctatcccctcacattcgcgcctgggtctccaccagcggccgtaaacccaatcccatagccaccgccctgatctggatgcataccggagccctgctgccggtgtgggacaccgccgttttgactgggcctgccctcggcagacgtgtgcgccctctcagcagtgacgccgaactgacctctcggcggtggctcgaccaggttgccgaccatcccggctttctcgacacccttatcgaggccgcccgcatcaccgatggatggcatcacgcgacgcctccgcacattcaggccccttaccggacccttcatcagtgaacggaggtacaacgacatgaccagcgacattgacattgaccggacccacaaacccgacgaccgcgccgaggctcctctttaccggtcctgggccaggagactcgtgcacgtctccgggatgccctggcgtatcgtcgccgccttggccggggtctcccccacctccatgcaccggcttctattcggccgcaacggtcgacccgtggaatggatcggcatcaatgatgctcgcgccctgatggatatcggcatcgatgatctcgcctcagcgtccaccgaccgtatcccggcccgcgaatcccgcgagctgttggtagccctgcacaccctcggctggaccgatgagcatctaagccgctggctgaccagttccgacctcgacctgaccaccgcccccaaagccctctacgtcactcgactatccgccgcccgcatccaggccacctacgacatgctcatcagccagcccgtccgccgctgcggccacccccgcaccccgcccgtctcgtccccgacccctgctgtcctaccccagcccagacccaacaacaccgaaccgttccaacccgccctgttcgagctggccgactgcgcatgaggaccctgcacagacgtgattaaatcgaagggctcaaccagtcatcaggagtcccccgtgcgtttgtaccgcgctgttctcgccgacaccgacatccatatcaccatccgtatctggaacactaccgatcgtgactggacctgggccccccttgacacttgggcccccgacccggccccgaccacaccagcccagttagccgatgaacttcaccgtcacggatggatcacccctgaggtccctactaccctcaccgaggtggctgtcatccccgagaactggcaagctttcgtcgagcatgccctcgctgtccggaaccagcaggctgaccaattgcgcgtcgccgagaacatcctcaccgacatcctcggcgacgccgccgacgccggcctgtctgtcaccgctctcgcccgcacgaccggactatcccgagtcgccgtctacaaacgcagcgccaaaaccatcgactccatgagacacgccacccaggccggcggaatcctcaccccctcctgtctcacccacgctgagagaacagcgctcggcctgcccgacgagtaacccatcgtttacatcctcgactggtccctgcgaccagtgaaccgtgcccccactgcgcccacaatgatcagcacacccacggcgatcatcaggtgggcagcactaactgatcccaacgaaccaagatcaaacaagccctgcccgggagcgtcgagcagtccgtgggcgcgaagccatgctccgagattgccaatgatcttggggatcatcttgttcagtagggctatccctccgatgccgacaacgaggaagacgaggatttcttcgcctgcgttgtttcttcctgtgtttgcggtcatgctgccttctcggggtggatggccagccagctgatgaggttgtcggtgatctgccctgagatttggatcagttcgacttgcccggcctgccatgcccgcgatgtgccggccagcaatgatgctgggacccctactgcgcggccacgggatgcaacctcagccaaggcggcgcgtaactcctcgacggtgctttcgatgtaccaactgccgtcagtactagtctcagcggcatcggtggtagcgataagagcatcggtgaggtcgtcgacggcgcggtccagatcagcgatgtccggtagggctacaggagtcatggtgtgtcttccttctagggtgccttcactggtgaagggtccctagccccggccgatgtgcggtgctgtgggaaaaatgcttcccattggtccgtcttagttaggaaacttggcctaagtgctgtcgagggtcgcgtgttcgtgaccggttcgaagacactgccgccttgtcttcttgcccgtggcgcttccgagatggtcagtgggcgatggctaggccgatgagggcgccgctgcacaggctgggcgcccagggaaggaatcgggtggtgtggtgtcggaaccggtcgattagggcatatagggcgatcagggtgaggccggctatgacagtgacctggatcgtgtcgatgccggttgctgcggccggggctgcccacagtggtgtgatgcgcacatcagagaaaccgaatccgcctcgggagatgagccaggcgatcatccacgctgcgaagatgatggcggtagcgatgacagcacgtatcgccgcagtatggtccgagagggcggtaacgactacagccccgatccatccggcccatccggtccacgctaggactgccggtatccatgtggtgatggcgtcaatgacggcaacccatgccccgatggtggctagcagagcccaggccggccaggtgggtgctggggcccacgctacggcggcgatcatggttgtcgcagatgcagcacagacagcgatcaagcttcggaggctgtaggtgtcgcggtagacgatcttgtcgggattggcggtagctggttctggcaggacgcgggtgagggcaggccatcctgcgaccgcaatagccgcgacggcgaccacccacacaatctgttgcatgggtctcatcatggcccatcatcgatgagtatgggtggccgacatggggtcactcgtagaggggatcgaggggtgtgcgggcgagcatggcttcctgtgtgccgagcatgagggtgccagaatcctcgccagccgattcccagtcgacgatgacctggtcgccgtcaacgctggattcggcgatggtcacccattctccgtcgatattgatgagcaccccagcggccagctccgtggcagcaaccgggtgaggtgggttgtagaagcggtcgatgtcgcaggcagggtcgtcgggttcctcgactaccggaggtggggtcgatctggctgtctcggtgtcgtcggccaggtcggctcccaggatgcgctcccattcggggctggttttcttgcccgctgaggccatcgtctcgtcgatctgttcgtcagtgggccacacaaatttctttttggtccaggtcgtggtgtcgggtcgcagctgatccagcagttccaggtcttgcggggagtgggccttgcgggggtcgggggtgtagaagaattggacttccttgggggctgattcgccggataggtaggtgccgcggccgcgtttgccgaacgggatgcccacgccgacgtgttcggagccgaacatcatgcgggctccgtcagcggacaggggtccggtggcggcacgcccggagaagttgtctcggatttcgccgcccaggaactcggcgtcggggcgttgggtccccagatcgacgtggatacggcaggcggctgccatgcgcagcagggagccgatccagccgaaaacggggcattctccgggcatcccagagaccttgatcgttgaccaccagtttttcgcgttgccgtagaactggcggtactcgtcgatgaggaccagcacgcgggtgaagtcggtctcgcgggccccttcttcttcgatgcggcggtagcggtcctccatgagagaccacagccagtggatgagggcgacctggtcggggacggtagtggcgaccatctcgatgttgggccactcccgcaggcccaggtactcgatgcgtttagggtcgatgacgaagacgcgccagttgcggcgggcaccctcgacggcgtcgccgatcatggacaccgtttttccggtacgggtgcggccggccttgagctggtgggccatgacaccggagatgtcccagaaacaggtgttgccgtcctcgtcgacggcctgggggattttctcccagtctggggagtctgggcccggaagggccacgggtcggggcaccatcgagggcagggggtggcggcgggtgacggtgatggtgtcgtgttccaggtcgaagtcgctgcgccactggccgagcatcatcgccgaggtcaccgcggccaggcgcaattggatgttcgggctggacaaatgggcgccacgttggtggtgaatggtgaagccgtccaggttcccccgatcggttttccaggaatcgacggtgaccgccgacccatagatctgagtggctacttctttagcccgttccttgtctcggtccagatcggttttgtcagggtcaggggtcggggcgcggtattgcaggacgaaccggccggccgggatcgttgcggatgtcaccgtgaactctgccggcgaccaggcagccgcggccgcctgggtgagggccattggcatggtctcgacggcagcctcctcgggggggatggtgagggtcaggcgtcgcggatgcgtcttcttgcgattccatgtgactttctgcctcaccggcaccttcgccgccgactgaatggctaggcgagctgattcggcagtttcggtacgccggccagcgcgtagcgcccgtcgtgcgtgaaggctgcccaccacagcacagcccatacacggcagccacgagcgcggatcagcggctgctgcatagcccccggtagctagtaccgcacctgaccagccggccgcgatacttttccacgccggtttcgcgccaccaggaccagcgttatggacggtctgcttcgaggctgcggagggacgagacagcggagtgctggtcatgccgcggcctccttgtggcaggtcatttcacaggcatgccggccagcgatgatgccgtggcgcaccgccccggtagccgcatagaccgcgcacaactcaaacacggggcacccatcgcaggccgccgggttcatgctttctttgtcccacgatggtgggtcatcggtgcacggcacggccaggccatcctgttgagcggcgctgatagcggtgaataggcgcagctgggcgcgaacttggtctggggtcaggttgacggtgcgggctacacgcatggggttccttcctcttcaccagtgaaggttccctagacccggccgatgtgcggagggatttcagtgttttatcgaggtgaccagccagccggtctgcgctgcgggttcaggtaccagggtcagatgcagcatggtgtggtcggctaggggcacggcgaccaggggcccgtcggcgctcgccccggtgagggtgggagttccggccacggtggtggcgggaatctggttgggtttcgcggccatcagggagcccatgagggtcggggcggcgatctggacgagggcgactttgcgggcggcgggatcgcgggtcaaccagccgcgggtgaaggtgagcgcagccgacgtgatatcggggctcagcggggctggtgtggcggcggggtgggccgttgaggagggccatacgcgcggtagcgctggcgacatcgagcgggtcggagtggggtcaggtgtggggcttagggtccgatgtggcgatggggctaccgccccggtggtgggagacgagactggttgggggtggtgttgagggcgtgggatcagggtgaaggcagccaaactggccgggatgaggatgacggccgcgccgacacttcggagcgaggtcatgtgacgatccttcggtagctcgacgggttgccgtagatcttttccacgttgatgccactatgtgggttgtcggcgctaaccatttggcctccaccgatgtagacggccacgtggtgggcagggcttccccagaggatgaggtcgccgactttgagctggtcacgggccaccgcggtgccgactttctgctggtcggcggcggtgcggggaaggctaatgccgatacgccggtacagcgccgaggtcaggcctgagcagtcgtagccgccatcggctttgccgttgccaccccacacgtaggcgtaggagttgttgtcggcgatcgatttggcccatgccacggcttcggccaggttcttcgacacaccggtctcgttagcggccccggtggcacagttgtttgacaggtgccctgtagtagtggatcccactatttgtttggccatggtttcccatttggcgtaggcatcgggcagggctgagccttgcactgcctgagctgcctgcgtcagcggcatcttctgccagtcagcgatgtcgactaaaccgggaatgtggaatccagggccgccggccgatccggggccagcgtaggtgatggtgtggcctttcaagaacgcctcggtggcgtaggcatcattgttgacctgatccagagtcccgtaccagcccggcaggatgcgctgctgaaaggggccggcgtcaccgtcaccgttagccttcgctgaggtagggtcggccccaagatctgattcttgtttggcggtcataatagcgatgaccgctgcctgggtaggcagtttgtcacgctggaccacagtgacgatggtggtcacgagctgcttctgcctggccgtgaggcctccggcacccacagtgcctccggtgacggtacccacgcaagcatccccgccgacactgccaccgccgacgccagagttgtcgtcgagggccccagagcctactgacagcagcggcacaatgatcacggtcgcgggcaagaccgccaggcccgccagcatcagcactgctgcactcaccacggcgatcacgtgagatgctttcaacgctgcccacctttcgctggtttgagggggcgacgcctgctggtacgcacaggcttggttggtccagtccgccgttggttggcaggcctgggtttgatcggcttgctgggacccggtttgggctccggagtcttaggctccggcttcacatgcctaggcacttcggctgcggtgggaggagtcagcacgtggcgtaccggcttggtgaccttctgggcacccgaaacaaccggcttagacaccaccttggcacctttgaccaccggtgcggctgccttcgcgccggccttcttgactgcacgatgcgctttgatagccccggcctcggcccggccaaccctgctagcagtagcatcgagggctctgtggcccgtcgttgccctcaccggtgcatccttgccctggcgggtctgcttagcgatcgccgacatgccgcctcgcaatgccgaaacatgattgtgggcgtgggcgatcgccgacatgccggccgtcgcgatttttgactggccctgcggggcccctgccccagcacgaatctgctggtaagccgccgacgtgccacgagcacccgccgccattcgcgccaccttcgcagccctagtcactcccgtcgacacgccacccgtggctaccgcagcagcacccgagaccacagtcgaggccatccgccttcgacccaatccggtgagcttgcgaccaccgctgcgcaccatccggcgagcaccccgcccagcccactggccgatcaccgagcccctttcggaacgcttgctgcgcatccaatcgttgatcttgtccctcagccccttctcgcccttgtgacgacgccacatggacatcaagaacccgataatccccacgagctcgagcatgttgacaaccatgaccttgatggcgacatcaccgtcagaggcgaaaaccgacttgatgatgagcatgaccacacccaacatcaccatcgacccgacaatgccgatcatcgagtacaagatcgaacacagatcccggatgagcggatctgtgcggccagggatagcccgcaacacgttgagcatcgacatgaacgccgaccacaccaacttgcacacgtagaaccagcacatgcccgcgaacaccagcaggaccacagccaaacccgccaccgtcgacgagtaaaagaagaaccccaccaaccacgaaccatccgcaatatcgccggcgtaatccgacaacccctcatcacagtcaccaaggtcgtcgcgagcatccgagacgtcatcgtaagggccacccttgagcacctcgatgtacttgtcgtggcacttcgcatcaataatgcggccatagttgagctgctgatgaaccggcgccacgaacgagtccacaatgatcgccgacagcttcggatccttcgagtctcccgtcgaggtcatgtcatcaggaatctcgacctcaccagcggtcgccgtcgcaggatcaaccgaactggtaatcatatgagacagcgccacaccgaactgctgggtgcgagccagcggagtagccaacgtcgtcgtatcgcctgcgaacttcgccaccggggccgccaagaaacccaacgccagcgccgcagcaatcgccgcacgcgcacccgtagcccacgcccctgccgtacgtcccctcatcatcttgacgaccacgcccacaccggcgcacgtcgtcagcaacgtcaacaccgttccaccccagctgtccgctcccagcggggccaaaaccttgtcgtggatgtcgttctgtaaccccaccagcggtccggtaatccacccgacccagctcatcgccacggtccagtccaacaaccggcacaacagggcaatgaccatcaggtacgtgttccaacacatgccaataatggaggcccacatagccttcagcggggccgtaacgccaccatcgtccatcgacatctggtactgaaacaagtgaataccgttggagtcagtcacattgaaaccgtcacccatccagcccagccccgggcccgatgccatggcaggcacactgctcagcgccaccaccagaaccagcgtggtgacgatgatacggaaccgccgctccccggccccggggcggcgtggatgacggctcacgctgtctcctggtcgtgctcgggcgggttggagctggcggcttcgcggtggggagcgtaggcaggtctcagtagtcgaatttcaccgacgttgccgtgttggtcggcgtacaggccacaaccggggcctccggggttgagggcaatcttgaccaggtcagcgaactcttcaggggacgttttagggtccacgcccaggaactcgacacctttctgggcgaggttgatgttgtcgcacagcaacacgatgcgatgctgaatgaggttgcggacggtctcgttggggtaatcggcctcggggtcgtgggagccggtgataagccaggcattggctcggcgggattcgcgcacgtactcgtcaatggcgtgggaggcttccggcgaggacgacatgtgatgaaactcgtcaacaatgaaagcggcgtcgcgggcccggtcgctgaagcacaccaggcgagccagacgggcaatgagcgcgtagagggctcggccaaacaccttgtgcgggggcagctgccgaaacagatgttctgacagcatctcctcggcgttaggaagagcgatgccacaagtgccaatgatgaggatgtcggcactcaggtcggcgggaggaaggtccgggtcaaagatggccgaagctagggaggccgagttctcgatgtcagcgaacacggcaatcctgtcagcgatcgcggtggcctcgggaaggtcgcactcctcggccaggtggcgggccaaacgcccacacgaggtgatctggtggtcacgcatgtaggccggtttgaggaccttggccagcgtggtcccggccacaccgatggtctccaagttaagcaaggtcagcaagaacgactgggcgacctgcccggccatctccgggggaaggatgcgcagcgggtccagcgacagcttggggtgggccgtgtcgacgatctggcgtctaaccccgtcgatagagttgacaaaggttacccactcccgctcatcggagttgtcggtggcaataatgcgcccgccccgggccgcgatggctgcgcacagccgcttctcggccatcgtcttgcccgcgcccatcttgccgatgaacgccaccgtgttgcctttctgatcctgagtgtcggcatgcaaatcgaggtaggccagcgactgcaacggggagcctgtgaccacagccaacgggatgccggtggtacggcccaaccggtactcaaccaccgggatagatgcggcgaacgcggaggcgtgagtcagctgacggtaggcgttaagcgaggaggagaaccggccaccgggccgggcagcccacagcaagtcctcctgacggcccacgggacgcacccacgtgaagtcaccgaacaccggatcattgacgaacgctcctgccagctcctcggtggtctcaaagtcaggagacgagacagtgacggtgataagagcctggatctcgacctcacgctcatcggcggccagctcggcgttgtagtcgacgagcacctgagcggaatgctcgatagacatgagggtcgaagcctgggtcatctcaccgccctcgacgttgtcgagctgatcgaccgtttgacggatagcccgctgatttttctgcatcgcagcgtgacgggtccgggccactccccggatcgccacgtcgaccggcacgccagtgtcgtcgatacggcccaaaaactcgtaggcaggccacgtcatcgtgcggggcaccttacccagcacgatatgggactggtagacggtctcgccggtgtcggcaccgattttgaggacgcgacgattccacgcctgagccgtccgggacatgtgggagactcgcttgtcatcctcgctggccagcaggtcggaggtcgcggcctcatcgatgaccaactcccccagcgcggcacgtccaacctcatccatgagggcgattccctcgccaggggcatcatcacgcaaccgggtcgggtggcctgacaggtgctgccgaagccagatctgttcatcaacggtgaccgggcggggttggaacgctgccggcagtttcgcaccgaattccttagcctgacggagggcccactcccgtgcgacacggccaggagcggtggtcatgagtccggcggcttcggtgattttgttgagggcggcggtccaggcggtgtgggtgcgtattttctggtcttggttgagtttgatcgataggaaccacacgcgccggcctagggattcggtttcaggctggtcgagggtggcgtcgatttcgtcggcccacacggggtgttcgctcaggtcaaggccggcggccatggcgtcgacgatttctgtggggtcggtccaggtgagggctccgttgaggcagaactcgtggcgggcgaggtggcggaataggtcgcggtgagctgcggcgacggtgagggaggcgttctcggtgacgggtcgctggaggggagtgagtcgccaggtggcccagatgtcgccggtggaggtccagacgaggttgtcgaagaggaaccgttcggggatggacatcatgactccttttcggcggcggcgaggaaggcttccaggccgctgcggcgtacagcgttcccggtagggtgcaggggttttctgggggtgggttcagatttcgaatgtgggaggggtttgtggatggtatcggtgtcctcggcgagggcttggtcgagcaggcaggtggccggggtgtcggtagtctcgtccagctcgtcgatcatctcgtcgaggaggttgggggtggtggatgcggcccacacaggtgggatagccggtgcgggtcgaggcggtgtggggaggcggagtttggtttggccccagaggggtgtgtgggtcatgccggcgggagtggtggcggcgtgagtggtcacacgccaccagcccgccagccatgccagaggtgaccaggtccagtcgatgcgaccaacaacgaactgggcgagccatccggcagccagcgcgaaaatgaaaccgcggatggtcatgcccccgtcgataattttgaagcccatcatcgcggcaggaactacgccgccgacagcgagcacctgatagatcgtgtagggcccgccaggaatccttcgacctgaggaatccttaccgataatgcggggctgctggcgggcctcggtgtgccactgaatatccacgatcagctcttgcccaatccttgcatcatctgtccgaagaattggatcgcgttaccttcgataagccagtgcgccataccacacacaaacagcatggagacgatcttggccaggctcataccgtgtttgaagatgttgaacgcggcaatgcccacgactacgaccatggcgacggctcgcaccgcggactgaccttcacctgccttgatcgtcgtccattcgaagaggttctgcgattccagtggcagcaggaggaattgatcgagcatgagaggttttcctttcaggaagccgaccgggatggtcccggtactgacgggctggacggcacgggtgtgccggccaggggcagaaggcgtgacggctggtcgagggaggcaacctcccagcggcctgcacggctgacaagagtcaggccgtactggctggtccgggtagtggattcgtcgccggtgggctggcatgtcacggtcaccgtgacggtaatcttctgccggtctgagggggtggggacctcgtcaggtcccaccacatgagtggttttcactgatacgcatggggctgggtcaaccgcggtgaaagcggtccctgggctgctccatctcgacaggtcggtattcccggtcagcatggcggttaggaagcctgaagaggcttgggcggccgggtcggcggtgcgaagctccgaggtgtctagggtgggggctgaggccggtgcaggcatggggatctgtccaggtagacgcaaggcgatggccttgccgttggaatcgacgtggaccgggactgaccaggcctgtccgctcccggattggccgcccatggtgaccacggtgacctgccacaggctcggatcagacggggagacggtagcgtcataggcggtgacggtggtgggcgctggaccaggtttgcggggcatgcgcgcatcggtgatcttggccgccaccaggtgttccagattgtccaagtgcccggagtcagaggtcagcagaagagtagtcacctcgaccgcggtggctgaggcgatctgagctgtgcggcggtcgtgatgggtggtgtcagtgctgacagctgtggtgggagcggatgccggggccgccgaacggaccagggcaacggggccgcatgcgactccgcacagcacgagggcaaggaagcctttggtggccatcgatccggtgtggggccagggacccacgttttcctgtgcctgttttttcttggccgaccaacggcgggacttagggttagcggatgcaccttctggggtgcatgctcgtctcaatcgcatcggtcacctccttcactggatgaagggaccaaggaggtgaccgatgtgcggtcgaacccgaaaaagttcaaacttttttctgggtctgcctcaagtacgacagaaggcctgcatcatcacggcgttgtggtagcagatcttgcgtcagcgcaaatgtatgggcctcgtaggagtagctcttaggtgggtcccggtggttgcggccagggcgagggtgtcgggtatgtgtagcgctagtcccgggttcgtggtgtgagggcttttgggtgctgacatgcactacccattgctagacgctgtgctgtggcatggctggacgtctagcagacgggttgacatcacctttaggctggcagcgcccgaggccgcaggccagaggaagcggacagcctaacgattgacgtccccctctcctttccccaacctcctggagtcgatgacccggagatagatcgatgtctatgcatctgtgcatcgatatacctatgtatctgtctgtggtttttagaggccactcccgtcgccccgggccgctcagcgataccgcaaggctgtgtgggatcagctgtgccgctctcccgacatggcagacagcaccctgcggactgactgacactgtggcgccgcggaggtctcccgcggcgtccgctggggcgagtgcatgcctgtcagctcatcttttatcgtcatgtttccccttgtcagagcggtctttgcaaagtgacaacgtcaggggtcttgacgacaacatcctcgacaacatcgtggcggtggtctgtgtctcgtcagttcaacgcaccggggaaagaggcaccgctgatgttcaccaccacaaacaccctcaacgatgagtgggaccagattcgcgccactgagatcgattggcatgactgccctgaactgatgcactgcatcgacgttgatgatgtgttggccgtcattcctgccgcccccgacgccatcttgggctacctcattgcccgggctcagggcggtgacgagttggccacccgcactatcatccaagcgttcacaggcaagcttatcttgatggccacggccaccaaggtgcgccgtactaatgacggcttcaatgatctgttggcgggtctgtgggagacgatcatcacgtacccgttggatcgtcgccctgacaagatcgctgcgaacctcatcctcgacacgttgcaccgggttacccggttctggcgtgctgattcccccgatgaggaagaggctcacggtctggtgcccttccctgacactctcatcgccccagagcccgatgaggacgtcacagctagccaggccatcgccttggcggtggaccgcaactggattaccgaggacctagcccgcctcatgagccatatttactgtgacggtatgactggagctgatgcgggtcgtctgcatggctgcgctccagctacggtgcgatctcgatgccgtgatggtcgggccgtgttgcagcgcaacgccgagacgatcctggccgtctgctgatccctctcttgctcatgcctgccgccaccctacccctacctgctagaaacatagccatgtctccagcaacgcatctagcgtatcttctagcaattgatctagctatgtatatagctgatgatctagctaccatatagctgtgtctccagcccaaaggacagcccaatggcatgcttgccacaggaaggtgcgtcagcctcccgaaatactggaaggagctttaccgtgcaggacatgacctcgaccagaccgattgaccgatccccgttcgaccgcactattgcggtgtggaaccacaaaggcggcacgttcaagacgtccgtcgtggcgaacctgggatacctgttcgccgccggtggcaacaaggtgctgctggtcgacatggacccccaggccaatctcgacattgacttcggtatacccgcgggagaacgtgaacggggcatgggattagccgaggcgctacgtgaggggacggcccttcccccaccgcagcatctcagcgaaaaccttcacctggtcagtggcggcgctgctctcaacgagttcaccgaccccgcatccttagcggccatcctcgaccgagtcaccaccgcacgctacgacctgctagctcaggcccttgccccgctggcctgggactatgacctcatcttcatcgactccgggccggcacaaactctgctgtcccagaccatccttggagtagcccgctggctggtagtgcccacccgcaccgataacgcctcaatcactggcctcgtcgacgttcaagacgccatcgacggggttgcctcctgcaaccctgaccttcaactactcggcgttgtcctagccggcgtgggggcccgggccacccggatcgccgcagataaacgccacgccatcgacacagtgctgggggcaggaaccgttttcgatgcggtcatccactactccgagaaggtgtccgtgctcgcacgccagcagggcaagaccgtcgccgagctagccaacgagtaccacaacacccagcccgcctacacctacctagctaaaggccagaacatccccaacgtcgccaaggcagccgtcagcatcgaaactgattatctgaggctggccaccgagatcagcgaccgcatgttcaccagcgacgagcaggagcctgatcatgactgacgatccgactccatccgagcagaacaaccccaccagcgacgacatgcgcttggccgaagaatgggccaacagcggccgcacagtgggagccctgccgcgccgtcaacggcctcagcgacccacaccccgcaccaccagccaaccccctgtctcgtcccctgacacaccggctccgaaaaaaccccagaagacccccaccagccagcctggccgtcaacggatcaacgtcaccgtctacgttgtgcccgaactccatgagcggctgcgctcccgatcggcggcgacgggggtgacggtctcggatctggtggtgcatgcgttagcgttcgtcgccgatcatgcgggggaggcgatcgccgatgatctgcgcgtcgagacgggccccggcatgggggccggactgttcgatgtgaccccatcgcggccagtaggggtcgccaaaacccagctgggggtgcgaatgacccgccacaacaaggatggtttggaccagctgacccggacgagtggagcccgtgaccgcagccatcttgtgtctgtcgccgtgcgcgactatctcgactccaaccctgtaaagaaaggccgacatgtccgctgatgaaactcctgccgcccggggtgggcgacgctttgatacgaccgtcaagcccaggcgccgtcccatgcttatcgccgccggtatcgccatcgtgatagtcggcgcgctcctcatcactcagttgattcgctccgcccaaaccgagcatcgcgtgctggaagtccacgccgatgtggctcgcggcgaggtcatccgtgacaccgatctggtatcggtgactgtcggccaggtcgacaacgtatcaacggttcccgcagaccagctcgactcactggtcggcaaacgcgccacggcagatcttcgagccggatcactcttgcctgctggggctatcggcccggccgatgtcgttccagctccgggcaagtcgctggtcgggctgaagctagccgccggacagatccctatcggagaccttgctgtcgggacgaagctgcgcctgatccagacgtcggcacccagcggctcatccaccaccactgatagcagcaccaataccgatggccagtcgtgggaggcaacaatggcgaccggcaccaaaaagaccgagcaggtcaccttgatcaacgccgaagtgaactcgcgtgatgccgcccggatcgcccaactgacgtcacagggccgtatcgccgtagtgaaggatccgatccgatgagcaccattgttttgaccagcgtctcgggagccccaggggtcaccacgacagcgatcgggctgggcagggtctggccacaatcgagcctggtcgtcgaggatgacacccaccacgccatgctggcgggctacctgcgagcctcccagcacgccgaaccgaacctggccgcagtggcgaacctgacgtcgactccaaccaacgcccaaacggtgtgggaatctatcgccagacccctacccaccgatgacccagtcggcgggctgcgacgcaaaggcatcctcggcccgcccacgccgtggtctcgcgcaggcatcgacccccgatggggattcatgctggccctgtggcggcaactggaggaggctggcatcgacaccatcatcgatttgggtcgcctagccacaccactgacctcaacgccacacctgatcgccgcacccatcgtcgaggacgccgacatgatcttggtgatgatcgaggcgacactacgcgacatcgccggcgcccgcacgatggtggagggactcgctgagcagatgaacttggccggcgcctaccgacgtctcggactgcttgtccaccgtggcggccaggcccgcggcgtcgccgagttcaatgacaaggagatcacctcggcgttacgactcccggtcatcggggccattacccacgacccggccggagccgcccaactctccgacggggtcgggcagcggttcgacaagtcacgtctggcccactcactatcaaaggtggcggccagcctcgtcgatgccataaacaagcgccacgctgatgacgaggaggatctgtgatggccagttttgctgataatccgttcgacaagctgcgctcccaggatgcggcaagagcttcggtagagcaggagcctgatgccggattagcgtcggagttgttttcgacgtcgtcggggtgggccagctctcagcaggtgtcccaagctcaaccggtgatgacccgttcggagaacgtggattggccggttgtcgcggagctagccagtacggccactgatgaggttgaggctgagatcagcaggtggagttccactcatgatggggtggcgacgctagacattcgccaggccatcgcggagcctgctattgcctcggcggtgtctacgtatgctgaccgacgccagatcgatgtaggggagacctggcctgatctggtacgccagcgataccgcaaggctgtgtgggatcagctgttcgggatggggcggttgcagccgctgttcgaaatcagcgacgccgaaaacatcatcgtggtgggtaaccatgaggtggttgtcgaccacaacgatggttcccggtcaacgctgccgccggtggccgactcggatgccgagctggaatcccagatcgcccggatggcgaggaatgcgaccccgcggcgagccttcgacgccgatcacaccgatgtgacgatcatgcaccaacagaagttccgtatccacgcgatctcttcggaggtgtcgttgcaaccgtcggtggtcatccgccaacatttgctcacccaaatcagtctgggggacctgtcccagcggggaatgatgccggtggaagtggcccggttcctcgatgaggcggtacaagctggcaagtccatcgtggtcgccggcgagcagggggcaggcaagacgacgtttttacgagcgttgatccacgccattccgatgcgggagcggttcgccacgttggagaccgatcaggagttgttcgctcatctgatgcctggccgggaaaacacgctggtgctgttcgcccgtgatggtaacggcgaggtggatccggcgactggcacccagcacggcgctatcgagatcgcccagctgattcctcctagcctgcgccaggcgttaactagggtcattgtcggtgaggtgcgcggcaatgaggcttcggccatgttccaggctatgcagtcggggactggcactatgagcagtatccactccccgcgagcctctgaggtgccgtcccggctagcccaaatgatttcgatgggcccggtctacgatctggatcaggccatgctgcagatcggtcattcgatcgactacatcgtctttgttcgtaagcgtgacctgcctgatgggagccggctgcgatttgttgagcagatccgttcagtctcgcctggtgattcgacaactcccagtcttggcgaggtgtacacggctgactcgtggacaggccagccgcttacgccactcatgcctggttcggccgccgacgagctgtctcacttcgcccgagacctggattactgcgaggcccactgatgaacaccccagcgctgatagcagccctcatcgtgaccggcctgggactgatcatggccatcaacggcctgatcccggccacacccaaacccggcaccacgctgacgctgtcacagcggtgggcccgggccacccaccgcccagccggggcagccgggcgccgacgcgacctgcgctgggcgctggccggtctcgtcggcatcgtgctgttcgtcctcacaggttgggtcgctgccctggccctgggccccatcaccgtgctgctagcacccaccctgctgggggcggccccaccgaccgatattccgctgatggaggcgttggatcggtgggtgcgtcaggtcgctgcggtgctgccacaggggcgagacatcatcacagcggtgcggatctcacggccgcgggccccgaagctgatcgccgggtcggtggatcaactggtgtcccggttggatggccgtatggagccgagggaggcgttccagcggatggccgacgagctggactcggctgaggctgacgcggtgctggcctcactagcgttggcggccactcatccgcggggagcctcgacaacgttgaaggctattgctggcaacatccaacagcggttgaaagtgctgcggcaggtggaggctgagcggtctaagccgcgtaactcggtgcgccagatcacactggtcacgatcgccatgttcggggggctgctcgtgatcggacggtcgtttctggccccgctggcgacccctcccggtcaggtgctggtggccgtggcggtggtcatgtatgtcatcgcactagtgcagatgtatcggatggcgcggccccgtcgacgcacccggatcatggtcaggaggacccgatgaccattactgctttgtccctgctggccggggccatcgtcactgtcggactgctggtcatcgtggcagcgttccgcccagccccaggccctgacctggttgccgctctggaggtggtgtcgggtcgcacctcaagcgtcgccgagaacgtcgaccagacccggatcgggcggataggtcgcagcgtgacccgcacattccatgtgtcggtgtccccggccatgcgggccgcactgcgactccaaggcacgacccccgaagcgttctacggtcgacgcctgatctgcgcactgatcggggcgatcctgccgtggctgctcaacgcggtagccatcgcggtaggggcgaattccccgaacctactcatcccttcggcgctgtgtgtggcgttagctggcgctggatggatgctgccggcagcacggttgaaggctgcggccgggcccaccaacgatgactcgttcgaagcgctgctggtattcatcgatttggtcgtgctggaacggctcgccaacgaaacctccgtcgacgcgctcaccaatgcggcaaacatgtcggactcgccgctattcgtccagatccgtcaagtcctcaaccgtgcctccctggaaaacgtcgacccgtggaacgggctagaccggctagccgaggacatcaaactgcccgaactcaccgatgtggtctccatcgcccgcctccaaaacgaaggcgcctccctcgtcgacagtttccgggcccgagtcgccgagttgcgcgacgcctacctgctgcgcctgcaacaagaatccaccgccatcacccagcggcttggtttgtggacgatcctgcaagccggctcggtcatgctcatcttgctgggggcggccgccctcacactcatcacagccggataaaccgacatcgtgtcgagcccccatatgggccgcgaacctttcataatgatgcctgtaagcaccacaatattgatcacaacctaacaatgaaggagaaatcatgatgaccgatctcgacctggctaaaaaacagatcacctggctggcggcgcacctgcgttcccggatcgttgacgagcgtggcggtggtagctctaccgtggagacactgatttggattggtgtcatcgtggcgctggtgattggtgtgggcgtcggggtgacggcctatatcaggtcgaagatgcctcactgacgacgatgcgtagcaggttcacaactgatcagcgtggcggtggtagcgcgtcggtggggatgctcctgctgatgcctgcgatcatgctgctggcattcggtgggatcgaggtcgggatgtggtgtcacgcccatcagtcgaccatcgcggcagcccaaagcgccgcggaggctcagcgtgtcgtccatccggtcccggggtcggcacaggaggcagcctcgcagatcactagtcatggcggggtgcgtgatacccggatatcggtcagtgatgacggggccactgtcacggtgaccgtctcaggtcgggccccatcgatgctggggctgcatcttccggctgtgtcgtcgacagcgtcgatgcccaaggagcgcctgtcgtgaggcgaagtgagcgcggtggagcaagtctaagcgtcgaggtgctcatgtgggcgccgatcgcgctggtgatcatcgggtttgttgtgggtatcggccggatgtcgatggcccaggacgcggtgaatggcgcggcgggtgctgcggcccgtgcggcgtcgttggagcgtgatggacagtcggctcagtctgcggcgcagcaggcggcgtcggcgaacctgtcgtccggtgggctggcatgtgcgccgaatgtgagcgtggacacgtcagtgtttgcccgtcctgccgggcaggcgggcacggttcacgccacggtcacgtgtgtcacctcgctgggtcttgggttcgggtcccggacggtgcacgcaacggggtctgccccggtagacacctatcgggaaaggagaggctgagatggcccgtgatgagcgtggtggcggctcggtgtcggtgtggatgctgctcatggtgccggtgattctggtcatggccggcctggtttttgacgggtcccgtcagatatcggcaacccaggcggcccaggacgcggcggttgcggcatcccgcgccggaactgatgcggcagcgacaccgcagcttgctggccacgacggggcggccgtagcagtccaagcggcccgccaggcactatctgctgccggggtggacgggtcggtgcaggaggacgggtcgaccatcacggtgaccacgtctcaaagtcggccgacagtgttcctgtcagcgatcggaatcagccaggtaagggggcatgggcaggcccatgctcagcttgtgggaccgggagaacgcccatgacagtgatacgtcgtatcggtgccctggtggcactgctggtggtgatagccggcttaccggccgggctcgtggccgcaggcgccccgctagtaccggcgggcctgtcatgggcccatgtgcggcatctgttggttaccccagacatgaccgggtcggtgctggtgtggctggtcagcctcatcggctggatcgggtgggcatggttcgccctggccgtcgcagccgaagcggtgacgatgctctcagggcagcggctgcactggcacatgcccggccctcgcctagtgcgccgagtggcagccggtcttctcattgccgcgttcgcggccgcaccggcagccacaagcacggctcacgccgccgaggccacccatgtggcggtcgccgcccaggctggaccggcacacgcggcccccgcccaggacagccccgccaccacctctcaggccccggacgcctccaccactccgaaaatctggaagacctacacggtgcgggccaacgactacctgtggaagatcgccgagcactactacggtgacggcgcccaattccgtcgtatcgccgaagcctccggtatcgacccgcactcagagctgaaagtcggccagaaactgatcctgccggttcctaagaacacggccgcagttcattcggttaaagcgggggagtatctgtgggagatcgccgagcactactacggtgacggcgcccagtaccataaaatcgctgaagcttccggtatcgatgcccattccgatctagccgtgggccaaaaactcgtcatccccgggcccctccgccacgacgccacgccgccacaccactcggcgtcgacccacgcgaaggccgccaccccagcccacacgcccacgcgacggcctgcgcctgcccacaaagccacgcccgccccgacgccggccaccccaactactccgacccacacggtgaccccagctccggcctctgccggccactcgaccagcgacgagcacccactccatacggataccgccgcagcggacaaggccagcaacgaggacgccctgtccccaatccaggtgggtttgaccgccagcgtcggactggtgctggtcgccggactgatcaccaccctcaaccgccgctaccggacccggttcacccgccagccccgcggcaaggccatgaccctgcccagcccggacgcccaaactgccgagatagcgctgcgcagcaccggggcgactgacactctgacgatcacctgcctcgaccaggcgctccgcgcgatcggcgcatggtgccaccactgcgggcacccgctgccacccctgctggccgcccgcgtcgatgacgaccggatcgacctgctgctatcccaggcggcccccgaccatcccgaggcggtggagctggccgccgacggatcggtgtggaccctcaccgccgaccggatcgacgacctgctagcccacaccgatgacaaccaagcggctccgtggccgtctctggtcacactgggacgcgacgacgacggcgcccacatcctcatcgacttggaagccgcaggaaccttgcacctgatcgccgatgacgaccaggtcgacgcggccctcgccgcgatcgccgtggaactggccacctgcgactggtccgacgaagtcaacgtcaccctcgtcggccaggtgtgcccgggcctagaagacgcactagagtctccgaccctgacccgcgccaccgacgtggacaccctcctcaccaccctagaagctcgcgccgacgaccagcgacacatcctcaccgaaggaaaccccctcgccgctcaccgagccgaccccgccatctccgacgggttcgacgccgaagtgatcctcctcgacaccgaactcaccgaagaccaccgcaaccgcctcgccagcctcgtcgaggctcttccccgcgtgtcagtcgccgcggtaacaaccagccccaccagctcagacgaatggtccctcaccctgacaggtgacccactagccgccgacctggctcccctcggctggcacatccacccccaaaccctctcccccgacctgtacaaccgcatggttgaactactcgccaactccgccgccgcagactacgaacccgccagctggtggaaccacgacgccgacgacgagcccaccaccgaccccaccaacgaggaagaatctaccccgagcaggcgagcccgcccgaatatccgcctgaccaccctgaccggcggcatcgacctatccagcgtcgacatcgacgacatcatcgacgaagccaaccaggccctcgacaacaccgaccagaccaccaaccaggttcgcgtcgacaccaaccaacccggcaccgacacccccttccccatcgacgacatcgacccgctgagctccgaccatccggtcctatccatcatcggccaccccgacatcacaggtgccactggaaccgttgggcgctccccgtggcgctgccaacagttggctctctacatcgctgagcatccgggagcatcgggggcgactatcgccgatgatttggggctatcagcgtcgacggtgcgctcgattgctacacacctgcgacactggttgggagccgacgatgccggggtggcttacatgccggcggcgacgcgcggctaccggctcgatgagcggatcgtcacagatgtggacctgatcgacgctgctgtggccggggcaggcattaacaccgctgagacggccacactggtggccattttgaagctgggccgcggacgggtcttcgctggggttcctgactcggaacttcgccagttcagggcgtcgatgtaccacgtggaggcccgcatcgtcgatgctgccctccaagtgacagaccgggccctggaagccggggacctggggctggcccggtgggcgttgacccaagggctactggtgtctcccgatcatgaggacctggtcaccggttgtctgcgcaccgagtaccaggccggcaacatggacaaggtttccgagctggtcgatcacctgtcggctaccgcacgacgcctgggcgtcgatttgagcgccgacaccacccggatcatcgactccgttattacccatacacgcaggagagcatcatgatctcccgttgcactcatctccgtcaggaaggttcctatgcaccattatcgtcttggtatcggcactgccctcatcgcggtagcagccgtggccggctgtcgctcaacagactcgacacccacaccacctccatcccgtgtctccgccacgacatcagcgagctctaccctcagcccgaccccgtcagccggagcgatcagtgccgccgacgccgaaaacatctaccgcaccgtccaagctaacaagatcgcactgtacaaaaagggtggcctggcacccggggaacccgcacccgcgacactgtcgaactacgccaccggccaggctctcaccgactacatgacctacatgcaccaaatctcggggcagggcatcaaaatcacatcggggaactcctcggttaccgcggtgcgggagaaaaagggtgataccacctaccccgaagccgctatcgccttggaatcgtgcgaagacgacagttcgattcgtaccgtggaccgccacggaaaggctgatcatggacgcattttccatgtcgacagttggtatgcccgcgataagaagggcaccgtcaagatgatcgcattcaactcaacggaggtccccacatgcgacgtcaagtaatcaccgcggccgtactgggcctggccctggccaccacctccctgcccgccctcgcaggcggcggcgacttgaacggcagtgtggacacggatggccctggttacgatgtgcgtactgaggtggattaccatcacaccaccggtggtgcgggtgggggtgccacgacagggggccatcatgggggcaaaacccacggtgatggtgaaggtgaggctattgatgggcgttctcgcgccgatgccgaagccgaactagacgaagccgaccgtaaccaggacttgacttgtgatgtcttgctcccaccggcgccgaataccccagccggccaggaatgggcgaaagaatgcaatcccccagcgaaaaaggggcagaaggccaccccgaagcccgatccggtgttagtgggccgtcacgcggccttgcagctcacccttcccggcgcggcccctcgtatcgatccgtcccccgaccttaaccggtggcactcggcagcagtgggccaggctttgtggttgtcggttgatgaccccaccgccactacgcagaaatcgatcacgtttatgggccaggttgtctcgttgagcgccaaacgtaacggtttgtcgtttgatatgggtgatggtcatgtcgtgcactgtgatgccacgacgacatggacggagtcggtggaaccggggaccccctcacccacgtgcggttacacctaccaacaggcagccccggccgggggctataaggtcaccgcaatcacgtcgtgggatgtgacctggtcggtactaggacacacgggcacagtccacatccagaaggccggtgggcagatgcttccggtcggcgagttggagtctgttgttacacggcgatgactcctgatagtccgacgctgtatgaggtgttggaggtctgccctgatgccactgatgaccagatcaagacggcgtggcgtcgtgccgcgaaagtgactcaccctgatgccggtggcactagtgaggcgttcgcggccgcccggcacgcctgggaggtgttgtctgatcctgcccggcgcaccgcctacgatgccgacctggcgggggaggatgatcccgacgacgaagccgccgacgccttcgacgttgatccgttcacggcatggccctggtgcgccccgtacatcgacgccacccccaccctgcgccacacctgccccggcacgatcaaggccatcgtggtcgccatcgccgggatcatggccggaatcggctggcaggaagcgctggaggccgtggtgtcgccgccggggtttctgggggcgtgctggatagtctcagtgccggttgtcgtcgcagtgacatggctggcagcggtgacgggtctggcatttttcaccatggcggccatctggtgtggatggtcgttgataggtggtgcgttgctgtggggccagacgtcggtggtgtggctgattgctgcggggtggctggcatggctggtgtgtgcgtgggtgtggtggaaccgtcatctggcgtggagtagcgagctgatgcaggaaggcaatttgtacggccttcccgaggaagacccgttgtggggcgaggccgtggagctggtagcgggacttatcccctctgtgcgggcgatgtggtcgcacgatgggcagaccgtgactgtgtcggctggccggcgggtggcgacactggggatgccgatgcggggatggcgtggtatcgagatgcgcggctggaatccagtgggcgccgatacgtggtggatcgttgaccaggtgggtagttggctggtcgatcaggatgagccgatggtcgttgacgggagggtgctccatgaggcgtgggaacggtcgcagatggtccgttcaggccgctgagaaaaaatttaggtccgccctgcatatcggggcctcttcataccttcaaaagtgtgaagggaatacagactcttcgactggaattaaaatggtatatggcgtgtccggtccgcacccagctccacgatgcgccataggggagccataacttcaccaatcgtatacgatatgagtgtaggtgagcatctaccggtggccgacagtcagatacaagcatgggcggatgaagcagaagctgattatgacctcagcatgcttccgccgtctcgacgtggtcgcccaccggtggggaggggcccgggcactgtggtccctgtgcgcttcgacgcggacactctcaaggcgttgtcacaacgagcccctgacgaaggattgaccacgcgttctgacgcgatccgtgctgcggttaaccagtggctcggcctcggctcgtaaacattatcggcgcgacaaccttactgatgacgctgttggttacgccgtagagcacatcttgtactcgtgggcgctcgacgatgctgatgatcctcgttgctggatgatgattcggtgttgacccagctggcctcctcatggagctagttatcctcatctacgacgatggctatgaactcctgatccacgccatgaaagcccgccctcagtatctgagctacttcgctatctagtgttgttgggcgagttgaactcaacttttctccgacgcaagcgccaataaaaggctgatccatccgaataccaccaaacacggctgacgtgtggaacagattcagcaagacagggtgcggtgctcgggtgcgttggggagatgaggatattcaggcttctggcgggatgtggcttgatgacgtccaggatcaccggttcggttttgaaggtgccttgcattaatgtcgacagggtcgtacgactcgaggactggatcgaccagcccgttgcgtctgaagaacttcatccaccccggtggagctccggccgcgtactggtgcaacggatcattagcatgggtagcgtgagtatgccttcgatcgtggtcagtgctgtcatcatccaaggttctgacgggcggcttctcactgtccgtaaacgaggcaccgaggcattcatgctgccaggcggcaagccggagcccggcgaggactcgcgtcaggcagtagtccgggaagtgcacgaagagctcggcgtcgcattgtcttccgacgacctgcgtcgggtgggagtgttcaccacgcgagcagcgaatgaggccggccatcaggtggtggcgacgattttcacccacaccccggttgcggtgagtgagccagctgctgagatcgagcagattcgttggctcgattggagtgtcgacgccctgcctgatgacctggccccgctgctggtcgaggcagtcatcccgtggctgcggcgccgtatccggtcggtcgctgtattcacgggtgcgaaggatggaaccgaccctcattatcgtgtcgaagcaaccgccttgggccggggtctcgcacacgccgggatcaccctggtttatggcggcgggaaggtcgggatgatgggtgctgttgctgatgcggccctcgctgctggcggcgctgtgatcggagtgatgccgcagcacttggtggacggggagatcgcccatcctagtctgactcacctcgaggtagtgcggactatgcatgagcgcaagcagcggatgagtgacctagctgacgcgttcgtcgcgctacccggcggcggcggaacccttgacgagctattcgaagcatggacatggcagcagctcggtgtacacagcaaacccgtggccttgtacgactcgaccttctgggcaccgctgaccgcgctactcaaccacatgaccatcgaaggcttcatccgccctgaggaccgcgcctcgctcgtgatcgccgataccatacatcagctgatggccgatcttgagggatggaccccaccaccaccgaagtggcgctcgtgacatagaacaaatgattctgactatggctcattgacatctgcgcagcggctactagctccattgacttcaaatcgggccttggccgaggctcggttcaggtggcccggaatggatccccacaaattgaatgctcatgatcgaggtgatgaacgcccactctattgtcctacgcccggttgtatccagcgagcaattgaaggtgctgcgcctgttggtcgaccaggccgagccactcatcatcgacgggcgcatcttgtacgaggcatgggacaggctgcaaacagcccgtccggcccgctagaaaaaatttttagggcccgctccgcacatcccggtctgtacccacaccttcaagggtgtgaagggaataaaaacacacctaacaacaactttgtttcatgatttggcgcgtcggaccctttctgaccgatgtcgtgcgcaacaatggacccatgagttcgcctaccaagatgcgccggaaggggacacgcggcccgaaacctcgcagcgacgaggagctaacggctgtgatgttccgcgtcccagagtcagtggccgaacgtgtcagcgatatggcttgggagctgaggctctcccgatccgatcttgtgggctggtcggccctctatgcactcaactcgatgctcagacagcgcggagaggacacgattccggttccggagtatctggacaaggccgtgctcgctgcgttgtatcccgatgggttgcccttcgacgaggacaccgaggagccgggcgagaatgccgggcaggaggagcttgcgatgactggatgagcccgaacatggttgaaggccgccccgccaggcgaccttcaatcaatggtttcggttgtcagctgcagccacccttgccaggtgctgtggttcttctccagaggaggagggaccgccatgaagacccagaagacctagaagatccaaaagaaccggtttcggctgttgcttcggtcttcatggtagctgatagcccgcgtcgttggaagtgcgacgacgccgatcctcatcggtatcgcaccctgttccagggtcgagaatgtgaaggattaacaaccatgacaagtcatgagacgccctcccggagggcgtcatgaccgctttaattcaagctctgccgacagctgaactgtctgctggacctggtgctagcagtccagctagaccctctgctgagggcttcatcaagattcaccacgacctcattagtgcgggcgtgtcgggtaacgcgatggcgttgttcgtcgcgttacgtaaccagcccggctgtgatcagtggacccgtcactcgtacctgcggctagcccaatggtgcggctgggatgggctgtcggaggcggcgggctgtaagcgggtgcagcgggccgctgctgagctcgctagcggtggttggctggaatcgcgggtcggccatgatcgtcgcaccgctaagacgctggtgtggcatcggttgaccagccccgacaccgaccgctgggagcaattgccgcggattgtgtgggcgaggatctgccagatcgccggggagacgtcgggagagtgggtgaggcattggctggtgtggcggatgctggccggtcgtactggtgtggctcaggcccctacgtccatcgtggcccggttcctgggctgttcttcgcgccaggtctctcatatccgtggggctctcgttgatgccggtctgctcggctgtgacgaggtctcgggggcggcgagccgggtgtggttcccctcgatggccgaggagtgtgcagcggatcgtgaggtggtcgatggggccgtcgtcgatgctgaggtgggctctggtgaaggtgtcgaggagggcggggaacccctgtcgattttgtccacccacccctgtcgattttgtccacccacccctgtcgattttgtccgccaagtattagacaaaccattagacagtgaattagaccctgggtcgcgtcagcgtgtgaactcaccaacgcgcgcgcgcgcggcggccgagccgccgaagccaaagaaacccataccaccaacgcctgaaccagcagcccccgcttcagacagtcctgtgtcagcgcacgctgatgaggctgccgagttggcgtggcagttcgtggggtggtgtcctcagctggtaggggcaccgaagaaggtgcgtggccagctccgccagatggtcgctgccgagatccgccggaatccgggctggctggatgcgccagcgttggaggttgttgcccagcgggtacgtgctgaaggtgcgctgggggtccagcactgtgagattgtgcgagccgagctgcacggggtgatcgccgaccagaaggccgcccccgcccgccccgacgccctgcacgcgcgggagcccaagtggtgggacgacgtgtactacgaaggaaacacaaccgtgtggtacgactctgacgaaaccagtgacgacgacgaggcgtggaaccggtcgcaggtatgtcatgttgctgagcgtgacgacatggctggcgggattgctaccaacctgctggcctcccacgctgatgatccgatggcctggctgactcgccgtcaaaccatgctgatggctcgtttcccccacgcccagaacgaggtcatcgcgatgtgccacatcgtgcgcaccgccctggaggccgacatggccgccggaacccggtgggaggactgatgagggtctcccggcgcgccctcatggccgtggcccgtgccgacgctgccgcagcagaccatgccaccggccgatgggtggccacagccaacgccaccgtcgcccggctgaccggactgtgcgaacgcaccgtccaatacgcccgcgccaccctggtccacctgggcctgtgccgcgtcgtggccaccggccgctacctcaccgccgacgagcggcgcacggctgctcgcacccatggcggccgccagatgcgcgccgcctccacccgcgtcctcaccatgtcctgcgcaatcgtttgcgccctaccccgaaggggtcaccactacaggaaagttaagttcctagatggtcaccaacgcacgcgcaggcgcgtgcgaaggccagcaacaccagagaagaaacccctgtggctgcaaaaactcgcagccctcctcgaccagcacctgccctggctggtgagaaaccatcacatcggccgactgtgccacgccctcaccgccctgggcatcgacgaacactggcaacccgcagacctcgacgccctcctcgacgccatgaaccgcaggaaccgtcgcctcggcctcgacgtgccatgcgccgacgaccagcacaaccccttgggactgttcatccatcaggcccgagacaccctcacccacgacaacccccatgaacgccgcctagcccgtgacgctgaacgcgcccggctcatcgacgaccaactccgccgccgcgcagaaaccgccacctgcgcagcccgcctcgcagccgagcacgccgaccccgactaccagacccgccgtcgtgaacgcagggaaaccctgcgagccacactcagggccgcccagcagcatgtcaggacacactgatacccgctcatacgcacaccatgaaacacgacaagccacctgacagtatcagctgcaagacgcatgacaacatagaaggacatgatgaaatacacatagacacaaccccgcacagcagtttcgcaacaaatcatgatagtctcatggcagtatcgcttgatacacacatagcatcactcccacataggcagttatgctgatatactcctactaggttatccgtccaacatgctgagtgggttcctgtacagcatgaaaggagcatggcatgatatgggccgttctcaactgcaagggtggtgtcggcaagacgaccagtgccctcctgctggcggcagccgccgccaagcagggccacaccaccctggtggccgacgctgacccccagggcaccgcatcccagtggtcagccctggcaaccaaaaacgacgaacccctgcccttcccggtgcaagcggtcaacatcgccaccatggaggcactgcccaccaccaccgacgcccatgatctcatcctcgttgacacacccccctcggcaggcgatctgatgttccaggcatgccgcatcgccgacctcatcatcatccccaccgccacctccggacccgacatctcccgaacatgggtcaccatggacgccacacaaggcacaccacgcgcgatcctcctcacccaaaccgaacacaaccgtgtcgtctaccgccaagctcgcactgccctcgccgccgacgacaccgtcgttctcctggaccacgacatcccccgccgtgaatccatccgcacagcatggggcaccaaccccccagacgacgtcatcacctactacctgcccgtcctcaacgaactcatggaggccctgtcatgaccaccaagaaaaccgacccattcgcccgccagaaagcagcagaagaccgcgcccaccaactccaagacgaagcccaacgccacgcccaccccaaacgcgtcatcggccccaccgcacgattccagttcgtcctgccagccgacgtgctcaccggcctcaaacacctcgccctcacccgcggcaccaccgcccgccaactcaccctcgacgccctcgacaccgcctacggcctcgacaccctcgccaacagcgggaagaaaacccacccatgacccgtgggtccccctgccaccaccccctcgacggcaactgtgtgcgagccacaggcccgcacacaggcggcagcccagtgccgtccccgccaggaaaggaactgaacttttctggagtgctggctccctatcaccccttatggtgctatcagatccagtagcgccagcccgagaggaaacccatgagctacatcgtccgcaccggaaatctagccggcacccccgagctgcgcgaggggtagccgacacggcggaccgtgcccctgacagtaagcggcactactggagacatcaccatgaccgctcagatcctcgccccgtgcaaccagaaggctgccgtcatcgaaggagccctgccatgaaccaacctaccccccacaaggccgacgagtcacagacgagcaacaccacgaggaagtggcggcacaaggtgtcgttctaccaagacccggccgacaccgaccgagtccgcggagcgatcctccacaccatgacaaccgaaggcaaccggaacctgagccagttcgtcaacgatgccgtcatggccaaggtgaccgaactggaagcaaaatacaaccacggcgagccattccccgccgtgggagcccgaggactcccccagggcggcgcagccgccaacagataagagggcggggaccaccaatagcagtcgatttcggatccagatcgggtagacaggacccatgatgaatttcatatcctccctgctctcggccatcctgaccctctttgcgatggtagccgtggcgataggagtggtgaacattgtgccgggaatatgcgccatcatcggtgcacggaaatacggcgaccaggaccgtgtgcgggcaggacaacgaaagatccttcttggtgctatcgccttggtggtagcagtaggcattcacccgtgacccacggttaccggaagccccgccgcaatcgataccactgtcagtaccatcaggggcgataggggtcaagctctccttgtcacaatcccttccccggcagcccagtaaccgtcgcttacagccatacatggatatgcgcccattcgtcggcaccgacgccgtgcgggttggcgacgctgacccgtctgctcacaaacgacccttccagcccagcaccacccactacaccgacacgatccacgaagctgaaaccgaacctcccatccccgtccgaaacatcaacgaactcatcaaccccaccaaccatgcatgaacgcacgatcgcctaccggccagccttcctgcgcgacgtgaagcggctcaaaaacaagcactacaacatgaacacacactcaaatgggcggtaaggtcacgaagtcgacgtggctgcctcacggatggcttcggcgagctcttggggtcgactccacatgggccagtggccggttggcagatccatcgcggtgaagttggtcaggtgcgcgacggcgctgaacatcggattgcctgctgcggccagctcgaggacctggacgctgggaatggagcagcagatcaacgtggttagtacatcatggcgagcgctattggacagcgcgacccgtgcccgggccacttgcgcgggttcaggaaccgcccgtgcccggaaccggtcaaggtgctcgttgctgaggccctctaaactggcctgcttgccgagagtatcgaagtcaggaagtggcagctcagctgtttcctcaggtagatctggtgcgaaggcacctccatcgctcatgggaccggagtccacccagacgatccgatggaccaactctgggtgcctgtctacaactaggctcaccggcccgttcgcgccactgtgtcccaccaggaccgcatcgccgcccatctcgtccaggatggctgagatggcgtcagcttggtcgtcgagcgtgcgcgtagtgcgctgggtgtcctccggatcgaggccaggcagcgtcagccccacggctcgactgccagcagtgttcaataactcgactacctcgtcccaagcccaggctccgagccagtaaccaggaacgaggacgataggccgatgctggtcaggtcgcgatgttgaagtcatggagacatagttgcacagtgcgcggacaagggagtggcactatttctggcatgaatttagatctgggtgtccggtgaggcgatcagaacgcctccatgtactgtccgagtgtctacgatgcagcggacacagtcgagcagctggctcacaagtttccaggtgtccttctgcccctatgagggaagtcggctgctctcgcaacctttgagggctgctctggggtcggaaccagttacagatcgttcaagttccgggaactaccgccggtcacgctgattgattcccgggcgatctcgcttctgacgacagtggtcggtaaccgagaggcgtcctactctgaccccgctgctgcggtgagtaaatcacgggcgtcccggatccggccacccgtccaagtgccagccagcttgatcggctaggcatcgtcaaggagcgacgatgaggtgatgatgcgatgtgagcgcaccgcgaagtgaggtataaagaagccttcccgggcgcatgcgtcgcccaggaaggccaggttggcccctggacggctgaatggttgggcggatcaggctgtagcggagacgtgcagtacctcgtaggcgatggcgttggttgggctctggtctgcatcgtggctactgagttcgacgaggatgacggtccaggtggtgatgtcgacggcggtgacgcgggcgatggtggaatcagtggatgctgcaaggaagtcggcggttatgtcttcgatgcagtgggacggagcagtgctggtgggcaggggcacggtcttgacggtcaggcttcgggcagcagagtaatcggcggttccgttaacaagctggtggacggtccagtcctggatcgggtgccggccgaagtcgcgtacgatagccgagtaaccaagttcgccccagcagaactggcgcatcccctctatgtcgcgccagacgtagaagggcgcgtaggagttctggggtgcgcctttgaccttttcttggatgaggtaggccttgaactccagtccatggtagccgtccatgaggtgtccagtctggatgacgcggtcgcggatgatctgcatgtcatagtcggtgggcagggtgatctgatattgcatggcgtacatcagcggttctccttggtttcgtgggagtaggtcgtggggatgacgggttcctgccaatcgatggttgacaagtcgtcggcggcttgttggtaggtaaggtggatcattggctgtttgagtgcagcgccatgccagtgtctctggccggcgtcgatccagatggattcgcccttggtcaggtgctggggtgcttgtccttcaatatggaccagggcaacgccgcccgtgacgtagaggccctgtcccttggggtgtgtgcctcagcggcaaacgtgacggcgtgggcggcacgcccggcgtcttccgtggcacgatcggccggatccatggcggcgcgcagctgctgttctgcagccaggcgtccaggtcacggcgggcagcatcgacacccagggcagcctcgacggcttcagggctacgacgctggccgggctggttgaccgcagaccactggtgccgggcgtcgtccagatcatggccggcggcgtcgatgagggcggtggtggcttcggcgcagcatcgcctgatccactccgaacgtgacaggccagctgtctcggcggcactgtcaatgcgcgccaggagagatttcatgggcgctcatctgtagcctccagataggcgttgatgtagcgcagagcctgatccgtcatgtcgatggcggctgcctcggcagacgacacaacgggctgtggatgataagaccacccaacatagacggcgaacatcaatttctcgacagctttcatgaggtccccggcggcaaccgcatccgcctcatcatccgaggagaaccacttcaggtctgaacggctgtacatagcccctaggtcctgatgtgggtcgaggtccttggaatgatggaagttcctacacacccatcgccaaagacctcaacatggacaacgctaccttcaccactccctcatctgtgaagagccagtttatgcacggtgttgaaagaggcgtcggtctacgacgaatgcgggttaatggtcttgcggtgtggggcgctgggcgatggcatcgagaacgcgtgagtgggtggcgatccattccgcgtcggggttgatgttgcgggcgacggtgtcgatcgctgttacgtagtgggcaagcctgcgaatctcagcttgttggtcagggtgatcgctgatgagaggctcttgatgggaggcgcggttacggacgtggcggatgagctccacgttttcctcgaagtcgcgtcggctacgccccgggtagtgaggcatacctccgttacgtaagtcagtgagagctttccatacggttgcttccaggcgcggggtgagcagaaagcgccagttgtccagtgacagactcgccacgatctggatcaggggtcgcatcgagtcctcgcgcgcccgcagtcgcttctcggccctggcgacgttacgcgggaaaccaccgagccgatagctcggggattcccaccaacgccgtatgccagtatcggcgctcaggcgcacgtcaatgaagtttctcaggagtacctcgacatggctgatgtcttccaagaacgctttcgagatgcgggtgttccacacgtaccacgcatcgactggttcgatccggtagcggctgagcctggcgggtgagaaccactcctgcaacgtctcacgactcaccgtgggagcgtggtaggattgatgacgataggcctcgggaaggtcaatgccgcgaaatatcggtatacccccgaggtcattgttttgcccaggcccctcctcgcatacttgcggggcgtcattggctgccgtcatctcgtctcttcccggtacgtggctgtccatgttcacgggcaggtacggcaatgaggttcccgcacacaaacctctaccaagcatacgctggcaagccccgacgagacgacgcctccgcccgccacaccaacggtcaccgccacggccacggtgaccgtgaccgtggcaccgaaacccaagccaaagcccaaggccaagccaaaggtaaaacccaaaccgaagcccaaggcccattcatgatcgcagtgcccgatacaaggtggagcggcccacaccaagctgggccgccaccttcgttttcgggacaccctcggcaacgaggcggcgagcgcgggcaagctggccctcgctcaatgccggtttccggcctcgatagcggccctgcttcttcgccaccgcgatcccctcggcctgtcgttcatggatcaacgcccgctcgaactcggccaaggcacccagcagatgcaacatgagctggctcaccggatcagcggaccccggcccatagacctgcccttcaagggcaggcccgttatgctgtcagcagatctgccagttgtgggtgctggtgtcgtagcagacgccggtgtcggtgtcgtcggtgcggttggtggcccagccggtggtggagtcgtcgagggtgatgtggtggaggtcgggttgagtgttgagccagtgagtcccctcggcttggggtaggccatcgaggatggctagtaggtgggagatggtgg

SEQ ID NO: 3 - DNA, 1010 bp, Propionibacterium acnes
atgaagaaaaactggttactcacaaccctccttgccacaatgatgatcgccatgggcacgacgaccaccgccttcgccagcccgcctaccgacatcactcccgaacatccaggcggggttacccgcctcacagccccgacggaatcccctcgaatattgaggggccaagtatgcccagctggacctctgcaatcaggttcgcaatgaagaaccccggcacgaaagtcccgggcaccaacgacttcacctgcaaaccgaggaaaggcacccatcccgtcgtgctcatcccgggcacatccgaggacgccttcatcacgtggtcgtactacggtccccgcctcaaggcagcaggattctgcgcctacacgttcaactacaacccggaaacacatccgcttgtggaagccgctgagaccagcggcaacatctactccacggcagctttcatggcccacttcgttgacagagtgctcaaggcaaccggtgctcagaaggtcaacctcgtcggccattctcagggcggcggccccctgccgcgcgcgtacatcaaatattacggggcgccaagaaagtcctcatctcgtcggtttggttccttccaacaggggaacacgcatgctcggcctggagaagttcctcaatgccagcggaaacccgctcagcactatcttcaatgctgcagcacagtttcgaaagctggaatccctgccccaacagttgcaagactccacatttctcagggaactcaacgcggatggaatgaccgtccccggcatcacatacaccgtcatcgccacccagttcgacaaccgagtatttccgtggactaataccttcatcaatgagcccggggtcaagaacatcgtcatccaagacgtctgtcccttggaccacagcgcccacacggatatccctaggacccgatgacccttcagattgtcatcaacgccttggaccccgagcgggccgccccggtcacctgcaccattcgcccattcaggcccagttag

SEQ ID NO: 4 - DNA, 2387 bp, Propionibacterium acnes
atggcgctcgccgcttctcccacagtgacggacgccattgccgcccccgggcccgacagctggtcggcgctgtgcgagcgatggatcgacatcatcaccggacgcagagccgcccggacctctgacccacgtgcccgagcgatcatcgccaagaccgaccggaaggtcgccgagatcctcaccgacctcgtatccggctcgagccgtcgaccgttctgatctcggcagacctccgcaaggagcagtcgcccttcatcaccaagacagcccgagccatcgagtcgatggcctgcgcctgggccacacccgggtccagctaccacaaggatcccgaaatcctctccgcgtgcatcgaggggctcagggacttctgccgacttcggtacaacccctcccaggacgagtatgggaactggtgggactgggaggacggcgcgtcaagagctgtcgccgatgtcatgtgcatcctgcacgacgtcctgccgcccgaggtcatgtccgcagcggcagccggcatcgaccacttcatccccgacccctggttccagcagccggcgtcggtcaagcccactgccaaccccgttcagcccgtggtctcgacaggcgcgaatcgcatggacctgacccgtgccgtcatgtgccgttccatcgcgaccggcgacgagaagaggctgcgtcatgccgttgacggattgcctgacgcctggcgcgtcaccaccgaaggtgacggtttccgtgccgacggcggattcatccagcactcccacatcccctacaccggcggctacggcgacgtcctgttcagcggactggcaatgctcttcccgctggtctccgggatgaggttcgacatcgtcgaatcggctcgtaaggctttccacgaccaggtcgaacgcggcttcatccccgtcatgtacaacggccagatcctcgacgacgtgcgcggccgatccatctcgcgcatcaacgagtctgccgccatgcacggcatctcgatcgcccgtgccatgctcatgatggctgatgccctgccgacacaccgcgccgaacagtggcgagggatcgtgcacggttggatggctcgaaacaccttcgatcacctgtccgagccgtccacccttgtcgacatctccctgttcgacgccgccgccaaggcgcgccccgtcccggagtcgtcgacgccgagctacttcgcgtccatggaccgtctcgtccaccgcaccgcggactggctaatcaccgtctccaactgttcggatcgcattgcctggtacgagtacggcaacggggagaacgaatgggcgtccaggaccagccagggaatgcgttacctcctgctgcccggagacatgggacagtacgaggacgggtactgggccaccgtcgactactcagcaccgacggggacgacggtggactccactccgctcaaacgcgccgtcggagcctcgtgggcggccaagaccccgaccaacgaatggtccgggggcctcgcatcggggtcgtggtctgccgccgcgtcccacatcacctcccaggactccgccctcaaggcacgccgcctatgggtgggtctgaaggacgccatggtagagctgacgaccgacgtgaccaccgacgcatcgcgggccataaccgtcgtcgagcaccgcaaggtggccagctcgtcgacgaaactcctcgtcgacggcaaccgggtctcatccgcgacctccttccagaacccccggtgggcccatctggacggagtcggcggttacgtcttcgccactgacaccgatctctccgcagatgtggcgacgagaaagggaacgtggatcgacgtcaatccctcccgcaaggtcaagggggctgacgaggtcatcgagcgcgcctacgcatccctgcacgtcacccaccacgatcgtccagtcgcgtgggcgctgcttcccactgccagccgttcccacacgatggccctggccacgcgcccaggagtcgagccgttcaccgtgctccggaatgacgcaaccgtccaggccgtccgctctgcgggtgccctcttgacgaaggaccccactgtcgtcaccaccttggctttttggaagccagctacctgcggcggcgtggcagttaaccgtcctgcgctggtgcagactcgggagagcgcaaaccaaatggaggtcgtcatcgtcgaacccacccagaagaggggatcacttaccgtaactattgagggaagctggaaggtcaaaaccgcagatagccacgttgatgtcagctgcgaaaacgcggccgggactctgcatgtcgacacggcggggctaggcggccagtccgtgcgagtaacgctggcacgccaggtaactcaaactccctccggcggcggccgccacgaccgagcctga

SEQ ID NO: 5 - DNA, 1113 bp, Propionibacterium acnes
atgcgtgttggtgttcctactgaggttaagaatagtgagtttcgtgtggctgtgacgccggcgggtgttcatgcgttggttggtcgtggtcatgaggtgttggttcaggctggtgctggtgtgggttcgggtattccggattcggattttgtgggtgctggtgcgcgggttgtgggtgatgtggagtcggtgtggggtgatgctgatttggtgttgaaggtgaaggagcctgttgcggaggagtatgggcggttgcatgagggtttggttctttttacgtatcttcatttggctgctgatgaggcgttgactcgtgagcttttggggcgtggggtgacgtcgattgcgtatgagacggtggagttggctgatcattcgttgccgttgttgtctccgatgtcggagattgcgggtcggttggctgctcaggtgggtgcgaattgtttgttgcagtctgctgggggtcgtggtgtgttgtttggtggtggttcgggtgtgcgtcgtggtcgggtgagtgtgcttggtggtggtgtggctgggttgtgtgcggctcgtgtggctgcgggtatgggtgctgatgtgacggtgtttgatgtggatgtggcgcggatgcgttatatcgatgaggtgtggggtgggcgtattggtacgcggttttcgagtccgttggcggttcgggaggcgtgtggtgagtctgatgtggtgattgggtcggtgttggtgcctggtgctcggactccgcatttggtggatcatgagatggtgttggggatggtgccggggtcggtgttggtggatgttgcggtggatcagggtgggtgttttgaggattctcatccgacgacgcatgcggatccgacgtttgtggtggggggttcggtgttttattgtgtggcgaatatgccgggtgcggtgccgcatacgtcgacgtatgcgttgacgaatgcgacgatgcggtatgtgttgttgttggctgatgagggttggaggggtgcgtgtgggtcgcgtgatgatttgcggcgtggtttggcgacttgtgatgggaagttggtgagtgcgccggtgggtgaggcgttgggtattgagtgtgtgcctgtgtctgaggtgttgtga

SEQ ID NO: 6 - DNA, 952 bp, Propionibacterium acnes
atggacaaaccagcgatagagatacgcgatctcgtcaagtcgttcccccaggccggcagccgcgaacgcctcattgccgtcgaccacttgtcaatgacgatcaaccgcggagaggtcgtggccttcctcgggcccaacggcgccggtaaatccacgaccgtcgacatgctccttggcatgaccagacccgacagtgggaaggtcactgtcctgggctccgatccgagaacagccgcccgtactggttgcatcagcgccgtctttcaaactggcggactgctacccgacttcaccgtcgcagagaccatgaaggccatcgctgccgcacacgggcagcgctcgagggtcaagcccctcaccgagaggtgggagttggccccattcgccggaaccaaggtcggcaaatgctcggggggggggtcagcggcagcgacttcgtttcgccctcgcgatgctgcctaaccccgatgtgcttattctcgacgagccgacaaccggtctggacgttgaagctcgtcgacgcttctggcaggtcatgggtgaggaggccgacgccggacgtacggtcattttcgccacccactacatcgaggaggccgattccttcgcccgtcgcgtcgtcctcgtcagtggtggacagctcgtcgcggacggtcccatcaatgaggttcgcgcctcggtgtccggatccactgtcagagcgactctcactgatccctccgtactggccgagggtctgcgcaccttccctgggattaacgacatcaccgtccagggccagcaactcatcgtgcacactagtcagcctgacgacctggcacgtcaccttctgacctacaccgacgctcacgggctgctcatctcgacgatgacccttgaggacgccttcgtccggctcacaggctccaatgattcccgtgacgatgttgacgactgggaggcagcagcatga

SEQ ID NO: 7 - DNA, 621 bp, Propionibacterium acnes
atgatcgataagaccatgatcaagctcgtgctggccgacgaccagaccctcgtacgcggcgctctggcagccctgcttagcatggagaacgacctggagatcgttggtacgtgtggtcggggagacgaggtgttcgcccttgtgcaggccacccatgccgacgtgtgtctgctcgacatcgagatgccaggtatcgacgggatcaccgtcgccgctgagctgagagaccaggcatcgtggtgtcgagttctcatcgtgacgaccttcgggcggccgggttatctgcggcgggccatggatgccggtgtggctgggttcctcgtcaaggacaccccagctgaggacctggcccgagtggtgcgcgaggtccatgccggaggtcgagttatcgacccagctttggccgccgaatccctcatcgagggacacaatcccttgtcggagcgggaacgggagattctgcggctggccgagtcgggggcctccatctccctcatcgcctcccagctctatctgtcggtgggcacggtgcgcaaccacgtgtcctcggccatcggcaagacgggtgctgcgaatcgcaccgaggctgccgtcacggctcgacagcgggggtggttgtga

SEQ ID NO: 8 - DNA, 707 bp, Propionibacterium acnes
gtgaccgtcctgctcttacgcctcgcggggcccttgcaatcctggggagattccagccgatttacgacccgggccacacgacgggaaccgacgaagtccggcgtcatcgggttgttggctgcggcgcagggacgacgtcgcaccgacagtctcgaagacctgctcaccctgcgattcggtgtgcgaaccgaccagccggggtcgatcgtgcgggacttccagacagccatggactgggcacatcccaaaaaggacggccgcgtcaaagccatgccgttgtcaaaccgctactacttggccgacgcagtcttcgtggcggcggtcgaaggagacccgtcctcctccaggcgttggacgaggcaatcagagacccggagttcccgctctacctcggccgaagatcctgtcccacggaaggacaggtgtccttaggcgtgcgagagagcgagctggtgaagaccttggaaaatgagccttggcacgccaagctgtggcaccaacgccgactgggacgatccgtccgacttcccatcgcctatgacgccgggccgggacagatcggcgacaccgtccgcgacataccgctgagcttcaaccctgagcggcgcgagtacggctggcgcgacgtcacgacgacaacgattgtcgtcgacaaccccaacggaagcgacgagcccgactggttcgcaggcctagaaggagcttga

SEQ ID NO: 9 - DNA, 588 bp, Propionibacterium acnes
gtgagtcgcatcgtcatcgtcaggcacgggcagtcgacgtggaatcgtcaagggcgcatccaagggcagacaatgggtattcccctgacgatgctcgggagacgccaggctcgccaggccgctcacacggtggcaggtctggtaccccacgacaccccgatcatcgcctccgaccagaagcgggcgcgtcagacagctcgtcctatcgcgcgggtgctgggcgtaccagcgacgaccgatccacggctgcgcgagcaagggttgggagccatggagggtcacaccgcggatgatctcgagccccttccccagccaacgggtgtacatccggccgacgtgcgatgggctggtggggagtcgctcgcggatgtggcggagaggtgccgcagcctgttggatgacgtggcagctcgcgacctaccggcgatcgtcctcgtcacccacggtgacaccatgcgggtcctgctggggattctcgacggtcgcagtcaccgcgacctcgactgggaccttccactgacgaacggaagtgtcatagcgcgagatgtgaacctcagcgagtcgcatcggcggctttcgctgtcgtaa

SEQ ID NO: 10 - DNA, 1010 bp, Propionibacterium acnes
atgaagaaaaactggttactcacaaccctccttgccacaatgatgatcgccatgggcacgacgaccaccgccttcgccagcccgcctaccgacatcactcccgaacatccaggcggggttacccgcctcacagccccgacggaatcccctcgaatattgaggggccaagtatgcccagctggacctctgcaatcaggttcgcaatgaagaaccccggcacgaaagtcccgggcaccaacgacttcacctgcaaaccgaggaaaggcacccatcccgtcgtgctcatcccgggcacatccgaggacgccttcatcacgtggtcgtactacggtccccgcctcaaggcagcaggattctgcgcctacacgttcaactacaacccggaaacacatccgcttgtggaagccgctgagaccagcggcaacatctactccacggcagctttcatggcccacttcgttgacagagtgctcaaggcaaccggtgctcagaaggtcaacctcgtcggccattctcagggcggcggccccctgccgcgcgcgtacatcaaatattacggggcgccaagaaagtcctcatctcgtcggtttggttccttccaacaggggaacacgcatgctcggcctggagaagttcctcaatgccagcggaaacccgctcagcactatcttcaatgctgcagcacagtttcgaaagctggaatccctgccccaacagttgcaagactccacatttctcagggaactcaacgcggatggaatgaccgtccccggcatcacatacaccgtcatcgccacccggttcgacaaccgagtatttccgtggactaataccttcatcaatgagcccggggtcaagaacatcgtcatccaagacgtctgtcccttggaccacagcgcccacacggatatccctaggacccgatgacccttcagattgtcatcaacgccttggaccccgagcgggccgccccggtcacctgcaccattcgcccattcaggcccagttag

SEQ ID NO: 11 - DNA, 20 bp, Propionibacterium acnes
ggtatccaccgagatggaag

SEQ ID NO: 12 - DNA, 20 bp, Propionibacterium acnes
gtggtcccaggtgacattct

SEQ ID NO: 13 - DNA, 20 bp, Propionibacterium acnes
cgacatcgacgtttcatctg

SEQ ID NO: 14 - DNA, 20 bp, Propionibacterium acnes
gtgttctcctcgtgctggtt

SEQ ID NO: 15 - DNA, 21 bp, Propionibacterium acnes
gataatccgttcgacaagctg

SEQ ID NO: 16 - DNA, 19 bp, Propionibacterium acnes
acccaccacgatgatgttt

SEQ ID NO: 17 - DNA, 21 bp, Propionibacterium acnes
gaagaatcccgctccatttcc

SEQ ID NO: 18 - DNA, 20 bp, Propionibacterium acnes
cctttcttgtagccgagcag

SEQ ID NO: 19 - DNA, 25 bp, Propionibacterium acnes
attgtcacctgggaccaccgtaaac

SEQ ID NO: 20 - DNA, 20 bp, Propionibacterium acnes
cgtgatcctgatcgactgtg

SEQ ID NO: 21 - DNA, 19 bp, Propionibacterium acnes
gctccacaacttcgagtgc

SEQ ID NO: 22 - DNA, 22 bp, Propionibacterium acnes
caggccgttgatcgtgagctga

SEQ ID NO: 23 - DNA, 20 bp, Propionibacterium acnes
tgctgataatccgttcgaca

SEQ ID NO: 24 - DNA, 20 bp, Propionibacterium acnes
acgacgtcgaaaacaactcc

SEQ ID NO: 25 - DNA, 22 bp, Propionibacterium acnes
ctctaccgaagctcttgccgca

SEQ ID NO: 26 - DNA, 19 bp, Propionibacterium acnes
atcgccgtcgacaggtagt

SEQ ID NO: 27 - DNA, 19 bp, Propionibacterium acnes
ccgagattctgcgcctagt

SEQ ID NO: 28 - DNA, 21 bp, Propionibacterium acnes
cggtgcccttgctgaggtaca

SEQ ID NO: 29 - DNA, 6363 bp, Propionibacterium acnes
gtgttgtggactctcggggtcagtctgtccgctcacttgagatggcttaacatttctgaccgacgccgaagtctacgaacgctgcgaaacgccaaccgacgcctttgtaaccaagccttcttcatcaagatctacatcgacgaagacgaccaactccgcgtcgagaacaaccgacctttcgaaatgctcctcgaccctcagatcaacgccaacgccctcacctgggcccagaacggcaacaaggcccgaatcgaaactaaggggttcgagccttgtgcgtggggttacttagacgttcattttgatacaaggatctgggtgggtgcacggaggggctaggtgggtgcattgcatcctgacaggagcgccgggtgagttctggttgactaccagcagcgtgttcggtatgctagaggatagttacgcgacagcgtccgttccaatttctgggagtgtgttaattccgatggtgctgtgatctccgttcggctacgccgagaagcgtccaaatgtttcgacggttttggggatcaatatgtctgctatcgaggtaatcaatctttctttttcattttccgctcagccactcttggataacgtttcattcagcgttggcgatagcgagcgcgcagtacttgtggggcctaatggctctggcaaaaccactctcctgcgcctgatacgaggagagctaaccccggatcgaggacatatcgccatcagtgatgcaggagatgcaggttcttgtcgcttcccttatgttcgtgacgccactggcacagttcaggactatctggacgacgtgttggctggcccatgggagttgctcactcgcttcgaccacgtgacgaagcaactatcggctgcccaaagttcagcgagtctcgctaaagagtacgatcacatactcaccagtcttactctggccgacgtatggtcgctcgaagctcgaatcgatgaagtgttagccggtttaggtctaggccagctgaccggacgcggtcgacagcgcgcactcggctcactctcccctggccaggcagtgcggctcgaactggcaggcatcattatggtcagaccagtaactctggtcttggatgaacccaccaatcatcttgatgacgaagccgtaggctttctgatccagcaaataacagattggccggggccagtgctcatggccagtcataatcgtgcgtttattgaagagacagccacggtcatctatgacctcgatattgccccgtggcaggctttggccacagctgaaggagaggctgtgtctggcgtgtaccggtgcactggcgcctatagtgattatcttggcgccaaacaacacgcccgcatggagcatcaaaagcttcacgccacccagcaatctgaaaaacgcgcgattcgaagtcatcgccgtcgtagcgaagatatcgctcgtggtggagtgaaattagcgaaggcgcagggcatggcacgtaagttcttctctgaccgggcagaaaagaccgcgctgcgacgcacgcgtaacgacgatcaacgcttacacgatcttgctgaacatgaggtgcgaaaaccccgcaactaccaacttaagctcaaccttccaccagtcggctcgcgtggcgggttagccgtcacggcacgaagcgccttcattccaggcaggcttctcccaatcacgttcgaccttgccacgggggaacatttaatactgactggcccgaatggagcggggaaaaccacgctcttgaattggcttgctagtgggaaaacaacaatcgaccctagatccgaagccagcggcactatctctgtcagcgggcggcttgcttacgtcccacagcgcctaccacgcacaggagattcctactttcacccagaacattggaaagacgggatcagagaacttggcacgggaatactccacccatccatgtgggccaccccagtcggccaactttcagatggaaaccagcgtcgagcccagatcgcgttagccgtggcgcagaaacccgagattcttgtcattgacgaaccaaccaactacctcgacctcgccacgcttgaagaactagaggacgcgctacgccaatggaacggcacactcatcatcgccagtcacgaccgctggcttatcaaccactggcagggaacacaaatcgaattatgccccacagatccagcgcccggatcaccgaatcccctcttactcgttaagagccggttcgagccgtggtagtgccgtccttgagtgtgagtttgatagcgccgtcgtggttgacggtggtgtgatcgacgagggtgttccaggcttggtcggagtattcgagtggtggttgggtggcaaggtagtcgcgtacttcgattgcttgtgctcggcggtggcgcagatcgtcgatctggtcgctgatccgttgatgctcggcctcaagttggtggtgccgatcttcaagctcgtggtaacggcggtcgtagtcgtcagggtcgtgggcggtcgtggctgcggggtgatgagttggttcatcagcgtgatggtttcttcgatccgctcccccagcgtggcctgcttggtttcgagctcgcgggtgtcgtagacggtttcgtcgagcaggcgcatggtgtcatcgagcacgtcgttgccggtgacccgcttagccagggctgcgacgaaggcgtctttgatctggtcttcggtgacgtggggtgtcgcgcagtgatgatccttgttgtatttgttgttgcagcgccagatgtagcggcggtatttgctggtggagtgccagactttccgcccaaacctcccgccgcaatcggagcaggtgatcgtgttggcgaaggggtgggtgttggaggtgcctttgcctgcgcggcgggcgagttctgcttggacggtgtcccaggtgacgggatcaatgatgggttcgtggttgctggtgacgtagtactggggtacttcgccttcgttgattttcatggtttggttaggaagtcggtggtgaagctcttttgcagcagcgcgtcgcctttgtatttctcgttggcaaggatcgaccgcacagtggagggcgaccagatttgtttgccacgcggggtggggatgccatcggatgtgaattctttggcgatggtttgtggggttgcgccttcgaggaagcgggcataaatacgacggacggttggtgcttgggtttcgtcgatggcgaggttgccgtcttcgcctttcttgtagccgagcagggacgcgtaggacaccatgattttcccgtcggcgaagcgtttacggtggtcccaggtgacattctcggaaatggagcgggattcttcttgggtgaggctggacatgatggtgatgagtagttcgcctttggaatcgagtgtccagatgttttctttttcgaagtagacctctacgcctttgtctttgagctggcggacgtggatgagggtgtcgacggtgttgcgggcgaaccgggacacgctcttggtgaggatcaaatcgatttttccggcgagggtgtcggcgatcatggttttgaagccttcacggtgtttggtgctggtgccagtgatgccttcgtcggcgtacatgcctgcgaattcccactctgtgcgggattggatgtggctcgtgtagtagtcgatttgtgcctcgtaggaggaggcttgttcttccatctcggtggatacccgcgcgtaggccgctaccctgcgccgacgccgagtaccctgcaccgtggtgtgtccgggtatttttgtggctgggatcgcggtgacacgcttgttccgaatctgcttggtggtcatatcgcactttcctcgtccaggctcaccgccactggcacttcgccgctaatggtgtggatggtgagcgtacgatcgggattgacaacgattttcacgaggcgcgtcagcgcatactcgtcgtcccagtcgtcgaggccaagcacgcgggtgcagatctgggtgagatgggtttctcggatttgtggtgcctggcagggattgcctttacctttggtggcggtttcgcaccaccaaaacttgtaggacgtgtggcggcgtgtcttggtgcggcggtgataaaacctgctacagacagagcattcaatccgagaggtgagcccggtcgttctagctgacggcgtggctccacgtccgagatgtctgcgccgggcgagctcggcctggacggcgccgaacgtggtctggtcgatgatgggcgggtgggattcgtcgacgaggtagcgtggcagctcgccggtgttggtatggcagttcaattctgcaacgtttggccggtaatacttttgcaggattacgcggccggtgtagatttcattttcgagccatttgcggatcgtcttaccgcgaaacttggctccccgcctaggcttgaccccttcagcattcaactgactgatgatcttggcttcagtctcgatgatagccaagtcactacccacgtattggtagccgtagggttggcgcgaatgcatgagcccgtcggcgtatttcttccttatcccccatttaacattcttcgacatggatcgagattcctcctgcgcaaacgatgccagcagggtcagcaggagttcaccgtcagcggtcgcggtatcgatctgttcacgctcgaaacgcactgagacgccgaggattttgagttcgcggacggcatcgagcaggtcgacggtgttgcgagtcagcctggatatcgacttcgtcaaaatcatgtcgatgtcgccggagcgggcggcggccatcatggtctggaacccctctcgacggacggtactggtgccggtgatgccttcgtcgatgaacacgcctgcatagtcccaaccaggggtggattgaatcagatgagagtagtacgacacctgggcggcaatcgaagatagctggcgttcgtgctcggtcgatacccgcgcataccctgctactcgtagccgacgtggcgtggcgggtctaggtgggataactcgaaaactacgcgaggtcactccctgcttctctttcttctatggcgacaggtgttttggttgtatccatctacgctctaaacctgagtcttatccagtcgaacctgcagcaacaatgcccccactggcgcggttgcttcatgcccgatccgcgtaaggatcacgtggctttcgtttggggtgagtgcgccggtttcggtgagccgatcaataaaggcgacctggcgggcaagatcgacttcggcattgaacatggcacccgtcacggtctgccacctcgggtgctgaagcggtgcctgatatagcaggcatgcgagcaatacttacggtgcttgtttccgtaggcctcgaagctctcaccgcaagcaacgcaggtgaaggtgtatattgcccgccggttgagccgttcggggtgggcgtgctaccacgacaaacgacacacatccgaacagaacctttgccccgccaccgcagcttcaaaatgcccattacagtgttcgcatgccttagcaggctcaacatcaaccgccggatcgatgttgatgtcagctctgcgacagatcgacttcaccgtattgcgcgacatgcccaatctggtggcgatctgcccatacgatgcgcctcggcatcgcagctccacaactcgctcacgggtaatctcacgtgccatgacgcgctcctgctcaatagaaataaggtctctactgacagggcttcgacccaccccgatttataaccaccactgtcctggtgcgatgggaacaaaaatggccccgccaccacctcatgtagtgaggcagcgacggggcgaaacaggacagttttcatgagtcttggtttagtggcggagtttttcgttgacccggcgctggacggcgtcgtagttggatccgagtctgcgtcggcgttcgttgccgttgccgtattcgccgcggatgaccgcgtcagcgagcgcgtcaatgttcggtgccggcttcggtgtgggtgcgggtttcggtgccggcgcgggtgcgggcgtgttgccggtcatgtggtcgtaccagtactgggcgcgagccatataggcggcgtgctgagtaccggccagcgatgctgggcattcggtggctgagaagtttttgtgcccgaacacgttcttaccccaggtagggcggccgagcttgtaataccgacagatcgcggccaccaaatgtgcgccgttgtcgaggcaggcgtcagagattttccatgggttagaagaggcgtcggcgtgctcgataccaatgctggtggtattggctgcccagtttccggcgtgccaggcggtgtcgcggtcccacacgagctgcccgatccgcccggaggtttctacctggtagtgggcggaggcgggccgggtctgccacac

SEQ ID NO: 30 - DNA, 20725 bp, Propionibacterium acnes
gtgttccagtgcctcgcgggcgtgatgttcttcttcggcaccttcttgccacatgcttcgcgcttcagcctcgccatccaagcgaacctggactgtgaacgagtcctcatcgggtccgtcctcattccacgcggcaatgatcccacgggcctcgtctgcgacctgactcaacttcatcgcctgcccgacagccccgagagccggaatctcgaacacccagatattcgcctcagccgagacctcacgatgggcgatcacttcgtaggtcgtctcaccttctactgtcgtgtccattacttccactccttcggaattttcacgcctgctcgctccagctgtgccaggacaccaactgacgtcagctggtgtcctgctggtatcgatacgcgcccggctccgccggggcgtccccagatttcatggcttcccttggcgttccgcagacgggcccatccttgagaacggagcagcttgaggacgtccttagttttctgcggtttcacacatcatagtatagccccacttaacttgtaaactaagcccctgtttacattttagttggtgcatgtgatccctgctcttatgacgtcgcccgacctggcgccttagacatgcactgttcatcctcaaccacactcaccgtcacgggtccgaaggcgaggtctatcaccattcgcatcgatgaagttgaagcaggatcgtccgcatcacgcactgccgatccggacagacgccaccggccgtaccgactgtttacgatctgccaccgcagactgctgccataaccgctatcacctctgatagtacgtttagtactatcagaggtgattcaagattctcctgtcgagcagccctacagtcacgaagtcctgcgatcgtcatcgcttaaggcagacggatggccatcggggaccactcgcaaagcaggggcgatcagcaacagtgatgtgccatgagcaagtactggtgcaccggctgtttactccgcccctagataaaccacgggtgcaggggtggacaccacaccatgaccgatgtggtgcccaccccatggctcacaggcaggccctatcgccgggagcactgctgcagatgaggctcagtaacctgccatgtctcacctggggccaaggtgccaagctccccacggaatctcaggcatcggaaaccagcagccgaacttccacagcatgagcgccctacgaaaaagcaggccgccgacggttctcaagaactcgccggcggcctgcatcgccactcgaactgtaaccgtggtccgaccccgtgcacaggtaagctccacactcccaccaggcatggccgaggcagtaccaagttgccgtggcccatcggcagatttggttaaattttgaaaagtcatatagactccttctgtaaatttttaaatctcataggactctcgccatcgccagccagcttcgacaggagtcccgatgtttcaccgagtgaaatatcggcaccgtttgagttgacctaaagctcaaaagatgctagaatccatcttacctcgttaggggcgttttgtcaaacgcccctatattgcgtgtcttcgcgcgtcgtagcgctgatgctgcgcctgtgtcgactatccgtttgtaagtactttcgatgacaccagcagtggctactcatgactggtgcgtgcgggtctaaagcagcagggaaaggaatcgcagtagaagccgcttgattcctatcacccctgatggtactatcagtactaacagagcagggcttactcgatgcgtgagaatcggggacatgctgagcctctcgtaggtcattggcctgctgggcgtcagtgtggcgcggttcgatccagtgaactctatcagctctgttagtactgtcagagttgatatattcgaccccaggaggagcccatgagttacatcgttcgcaccggaaatttggtcgacacccccgagctgcgtgagggagagcatggcccgtacacctacgctcgcgtcatcgtgtccgatcgcattcgccaggaggacggcagctacgtcaacgggccagcgatcgcctacgacgtcttggcgggtggcagccaagccgtgaatctggttgaagccgccaaggcgagcggcaacatccgcatcatgttcgcgggccgttaccgcgtcaccgagtggcggggtgagcagggcactcgtatccagcatgaggtccgagccgacgaagtgagcgtgagcctgctcggtcagagggtgaccgtggagcggcctcgaggtgacgtggcatccaaggagagcacgtcgttctgattgagtccgggggcacggtggtcgccgtggtaaaccgtgcccctgacagtactattgacactattggaggtatcagtgtgactgctcaaattttcgccttgtgcaaccagaagggtggcgtcggaaagtcgacatcgacgtttcatctggcccgtgccgcggtgttgcgtggccagcgtgtgcttgtcgtcgacaacgacccccagggcaacctgacgtctgtcgcggccgccgagcccgtgggggaggatcaggcggggctggccgatgtgctcagcgcgcgtgctccagagaccctccgcgatgtgatcgtgccgggaatctggtctggcctcgatgtcgtgccgacgtctggcatcacgctcggctgggtgcgtgacgaactcgtgatcgccggtgccggccgagaaggccggctgcgggaggccctggccggcgtcgaggacgactacgacgtgatcctgatcgactgtgctccatcgctcgatcagctcacgatcaacggcctggtggccgcccagggtgtcatcgtcgtgacgcactcgaagttgtggagcgccaacggcctcgcccagctgctcgacaccatcgacagcgtgcgcagctactacaacggcgcgctgcgcgtggcgggcatcatcgtcaaccagcacgaggagaacaccatcagcgggaaaacctggctcgacgagctgcatcaggctgccgagtcccggaagctgaccgtgcttgacccgccgatccccaagcgtgtcgtcatcgccgataccgtcgaggccgcgcgcggtctcgacgagtggggaagtgccgaggcggccgcgctcggccagttgtacgcccaccacctgacctgcatcgaaggagccctgtgatgacccgtccagccccccgaaagtcctcattgagcggatcaactccggtcgccccgccggctcagacggcgccggcaccgtctgccgcacctaccccccacaaggccgatgagtcacagacgagcagcaccacgaggaagtggcggcacaaggtgtcgttctaccaggacccggccgacaccgaccgggtgcgcggggcgatcctttacacgatgacgaccgagggcaaccggaacctgagccagttcgtcaacgatgccgtcatggccaaggtggtcgagctggaagtcaagtacaacgatggccagccattccccgctgtgggagcccgaggactaccccagggcggtgcagccgccgccggtgagtagaggaccatcgaccgtcgggggcttcaccatgcccccgaccctcggtcatcctgatcctcttgtcgatggtggtgacagtgggggattcacgcctcgttcagatcagaggaagtctcaccgcgtgattagtactatcaaatctgacagtactaacagagcagatagggttccctaggtcgagctgtatcacgccgacaaccagtgagccagtgatctacgaggggcgcaatatgcacccgatcggtagccgcgaaggcctcgccctgccccgatagtactatcaccactatcaatggtgctagtggtgagtttcttccattgatgacaacagcacagtgctgccgtctgtgtgcgggccaccagcccgcacacagttgccgtcgaggacgttgttcatgctctgtggtggccggtcctgagggcggctcgcaggatctcccggcgctcacggcgacgagcctggtagccaaggtctgcatgttcggcggcgagacgggctttgagggttgcggcttctgcacggcggtggagttggtcgtcgatgagttgggcgcgggccagacgccgcttatgggggttgtcgtgggtgaggggggcgtcgaggctgccgtcgtgggttagggccagggctgctcgttcggcgtcgtcgaggccgatgtggtggacggtcacgggtgcggtggtgacgtcgaggatgtccaggtggatgttgtggccgccgccgggggcttcggggaagtctggtgggctggcctggccggtgtcggggtcataccaggacaggccgatgatctcggcccagggtgggggcgggcagacggctcgcagaagggtgtgggccaggaacgtgttgcgggccatgatgcctccaagggtgaaaagcagtcgagtagcgatgacggcggggtagccgtctgctgggctgaggccgaccgggcccatgtcctcgatgctcttgtgctgcggccataccccaaagctaccaaacagtctttttaatctcaaagatacaaacagtgcttgacatattatctgcagcgaaagatactttcatcatggtggctgatcatgattacgcgactcctgacgatgagtggatgacacctcctcaggtggcccgtgtgattccgaacaccactgctcaggctgtccggcgctgggctgaggagggtcagcttcctggggcgtttcgtactccttctgggcgttggcatattccgtggtcggctgtggtgggcatcatggggtttgatccgcgtgagtccgcatcaccgagtgatcgtcaccagagctgacagagtcgtcgatgagctttcgagtgcagagctgatggcacgacggtctggatacttgtggagatgagagacgaccacatccagtcatggtcggggtacaccgaggggcagattcagcagtgctggcacgatgaggttgcccctgccattgactcgctcatggagcaggtaaggtctgttgccgagactcctgtgccgccgggttcgagattttacggcgatgagcagtgggccaagccttttcatccgtctactgcgatctgcggttcaatgggtccgccagcgatcacttgcacgcgctgaagctcctcgtctgggaagcgaacgtccaccatgtctatgcgccgtacacccttgctcgtgcatctattgaggcatcgtctactgctgtgtggctgttgagcacgaagacgcgcggagaacgtgtgctgcgagccttgcgatggtacgcgcaggattgtcacgactcgtgcaggttcatggatgatgagcagtatcgtgaccacctattgcggcgcattgaggggactgtcgctgcgggaaatctcgactcgcgcgctgctaggaaacggtaccgtgcaaccgatgttgtcgatgaggctgatcagctggttcccggaactctgagggcgtggcgagctttttctggtatggcccattcccgtatgtgggcatccagggggctgctcgacatggaagtgctgtccagtggccaaggaatggttacggcgaaggtgacgagcggatcggcccaaatcctttgggccgtcgtggcagctctgaatgttgctctcagtgccgctcgcttgtggcgtgattcgatgtgctcaccgtttgctgttgcccagtcggtagacgcgatgccagaggcgtttcgccgccctgtttagggtctgatcggggtagtgggtgttcacggggtcccaggttggccatggggcggcttggtgatgtgagttgggttgtgtggcagcctgggtgttgggtgtggcttcgttggccacgaaggcatgctcttccttgtgctgggacttgagtccccagtgctctcccctttgctagtggggggtggggtccccggaggtaggtcctccggggactttttctatgtctgtccgtgccccaggatttcgtatctaggcagtaccaattttgggttagttggaggtttctttggtaatggacagggtgagggtgatgaagaggtggccgtccttggtggcagaaattttctcgaacttcagctgaatgttgttatcagccactatctgttgggcggtgaggtgctcggagagcttctggaatccttcgcggatccacaggttgtaggggttggtgaccgagaccgaagggtatgggtcgaccttcagcgtcaggactggctggtctgggttgagggagttgatcttcaccagtttggggtaccggtcgcactcatgtgtctcttgtgttgggggccagcagtcgggggcccattcctcccagtggtcacgcatctcacgaagtactttcctgcatctcagcctctgcaggagctcgcgcgccaccgatgggagggctgccatgatgagggcaaggactgcgaacccgatgatgtaattgaccgtgtccctcgtcacgccgttcttgccgaggattccgatggcgaacgcgatgacgacaccgcccaggcacaggtgcatggggtcatgctgtgatggtttttcttcttcagcgactggtggggctatagtcatgtgtgccccttagtactaagtgatactggtgggttgcttttccccggtggccgtgtgcaagacggccaccggggttttccttcatgttcctgattttatctgcccggtgtggcgttttcatctttgtgtgggtggttcgcctggggtcttggagtgtggtgacgcggtgatggtcacggtgacggtgactgtggcgcgtggcgggtgaggtggttctttcctggtctggtgtgtggcccaggtgagtgtggtgatgagggccagggtgaggatgatgaccagggtggggagtagtttgtctggccggtgtcgccgggcttggtggcgcggcatgtttttccagggtgtgtctccgaacaggtcgtcgtcggaggggtcgtcgtggttcatagggtggccttggcgatggtggtgggcgagtttggtccaggtgatggtgccgtcggaggcgatgtggcggtcggcgggcagggtgtggacggtccatccggcgtcggtgagggcggtggtgaaggatttcttgatggatcgtttgggtaggtcgatgggggcgtgggtgccgacccagatgcaccggtttttgaggtgggtggcgccgaggtggttcatgtcgcggaccatgttttgggtgagtgtgagggtgtcggggtcccattggacggggatgatgatgtggtctgcgatggtgatggcgtgttgccaggcggcgtcgaggtcgttgtttccggtgtcgaggatgatgacgtggaagcggcttcttagggcggtgatgatgcggtcgaggtcgtcggcggtggggggtgtgatgaggctgttgtggttgtcggtgatggtgggtaggcatgtgatggtggcccagccttctggttgccaggagatgtaggggccgaggtcgcggggttgggaggcgaatcctgggtgacgggctgcgcgggcgaggtcgatgacggtgttgtcggtgtggcggggtgcgcgggtggagagggtgccgcgtgggttgatttccacgacgacgatgtcgtcgtgtcctgctgtggtggcgagggcttgggcaaggatgacggccagcggggttttgccggtgccgcctttgaggttggcgagggtgatgatgtggtcggtgagttgggcgggtgcggcggtgtggtgagggttggcggtgaggttggcgatggtgaacagggcatcgagatcgtcggtggtgttctgctcggtgggttgggggtcgccggagatgatcgggtcggcgcggcgcggctgccatgccggcctcaccactgtcacgaccaccacgggtctgctggcgctgtgtgggtgtcgtcggcgatgactcacgatcggcagtctcaccatcgtctcggtgatgctcggctagcgctggacccggtcaagttcgggccggctcacccagtggtgatgactcggtcacagaaccgctgccggtcgttatctcggacgtctcgactcctccagtcctgatgggcgttggagccacctacacctactctcagaacgaccccgacctcgtgtggggcgggggcagatgtcacttgggccaatcgagagcccaggtgatggggaaagcaggggtgtgatatctgtcctggaaaactgggcagctgctaccgtggattgacggatctccacgaaagaagggaatgcgaccatgcagatcaccgtcaagaccatcaaagatcatcgggttcgcactgtccagaccgccatgagcagcgccttggggattggttcccaggtagacatgctcgcccccggcggttccaccagctcgagttccggttcatgctgctcgtgctcgacctgcgcggtagtggcgcagcctcaagactgaacggctggtcagccccaggggcgtggcgctcatcgcgtcacgccccttctattcgctggacagggtgcgcgagctgaggaacatcgcggtgtgtgcgatgacgaggggcaggagcaagtctgtgcgggttgccaagtagccctgcgcgatggccatcacgctggccccgacggcggcgaagacacctccgatacgtcgcttcatgccgccgaattgcatcaggacgaataggactcccgcggtccacatccctccgggcatgcatctgggaaagatgaaccggaagatgatctcttcacaggagagctggagtactagcagcgtagcccccacggggagactcacctctactgacagacggatcgtcttcatccacccacccgagctggcatcgaccatttcggtggccatgcgcgaccggtggcctcgtgcctctcgctgcgtgtcgatccagccgagcagtccgtggacgctctccgctaggactcctgacgcgacagtctcaccaattcctaagcccacggcgaggaccgcgacgcccccctgcacggcaggctgtgtgacttggtggtcccaccaacccgccggcaggaccatgcgtgcgaggctgcacacgagcaggaggtggagggtcacgacgagcgacatctggaataccgcttgccgttcggcgatggtggcgttgggaaagagcggtaggccggcacgggcagcggcgctcgacagcttccgcaagagcggtttggagacgaagtagtaggcgacgtacagcgccagcgctgtcgcgatgatgatcatcggtctgccaccgagctgacccgccgatagccgtttctgttccaccaatactggctgttgtagatcaggtggcccagaacacaggcccagatcccccagaagatgaacaggatagtccccaaggcggcgagcgggatcttggagaggacctgtccccgtccgaacaccgagtggccgcaagcaaacaagagtgctcccacagcggtgagcgcgagccaggccggggttgctcgcagactgatcaccgggaccccgacccggaagccgacctcttctcctacagcgatgactagcaactgccacagcggcatgttctgaacggagcgcgcgactcgggctcgagtcacccacacgggctgttgagcgctcacatcaccactcaggtaccccggtgaggcacttcgcttagtactggggcccgatgtgcgagcattcgtgatgtgtcgcaggatccggttgtcaagccaagaggccagcagggctccggcgacagtgacgggtagcccgatcagcacgaggccccagccatgcggtgccgagaggtttctggccggcgtgcacgcgaggcaggcaaatgccatcactgccagcactacgacgtagatggtcgcataattcgacttgcgggtgacgttgccgaccatcttggccaaagtcgctggggaccagctgatgagtgcgatggtggtcagcaggaagcaggaccagacagacatccggcgcactcaggggtatgggtgcggctgtgggttttggaaaccgccatatgcggcgtagcgggggtgtgcccgcatgggtgcgctgggcagtgacagggcgagcagcccaggcgcccagagcctgacacagtgcagtcccagcccctggatctctatggtggtgaaatcttcgatgtacaggggtgacacacaggtgatgctgttgaccacgctctttaccagttccgcccccgtgtgggtgtcgtcaggtggcaggtcttcggcttgggcaatggtgcccgcgtcgaatttcgccacaactgattgcgcggcctgatagttcctcgcgtagtaggagacgttcgagtcgaggtcaagcatgtcctccgtggacatactggacgcgtcggcctcggcgtcgaaagacgtccataccgcgagcatccgaaccccgctgcactcgagaaacgccttgtacatggctgcttccagacccgcgtctgcacctaggccgacggcgacgaggggaagttggttgccactaccgaccatcatgcatgccacggtgaaatgcttgagcccgggagtcggaagccagtagaaacgcagttcgtggcttcggcccgctgcacgttccacgagccgctggatgcgctggaggcggggtccttcgacgcggatgcgcacaggtgacgaggctccataccacaggcccatcgcggcatctacctggatcaattcataagccgcggacagcgttgcggcgacgcgtgaagtgtggacggcggtgccggtcgtcacggccgttcccagccacggctcaccgtcgtgccgacgggggttgtaacccaggtaaaagaactgcgccgggatccactcctgccgggaggtcccgacacggggagtcttgacccatgtcatgggcaagtcgtcgcgataggtgtcgaacgcacctccagccactcgttgcgcgaagccgaatgcgcccagatcgagaacttcgtcctcggtccgggcgaggagttcctgacgagtcgcccagcgccgttcgaagggactatggagaatcccggtacccgcgcagtagcgctcgacggcctccgcgtagaccttgatctctgcctcaaactcgttcagccccaccccaccgatgtggtagctacccggcttggggtcgggccggtcaagcagtgcgtgcatccccgtgagttccccaccgttcacccgcacgcgggggccgagcgcggggtgcagcgagtagccgacggaagtcaccagcccgcatagcgggctgtaggtgcgccgcctgagccgggctgcggtctcgacggggtcgctatcctggcgaagcttcatcgctcgccccctgccgccagccactcacggatgtcgtagtacaggtccggagcggtttcaacctgcgctggtgcatcaaaacgggacataggtaggacgtcgttgtaggcgatctccatcgtcggtatgtagaccgacaacactttgttgcgcgtcgtgttgaggccgttgcgggcgatgctgacagcctcatgcgcgacgtgcgcggccaagatcgcgcgcaccgacgctgccacggccggcgctccggcccttacgcggtcggcagcggccacccgcatccaggacaggtagctctgccgttcgcgcaggttcatcgcgacccgctgctcgaaggtccggtaggacgaggtcgcaccagggacgacgtagggacccacgtacaaggccggcccgtctacagctgcgtggagccacgacaggtgggcgcgtcgggcgaacaggtcaagggcgcgcagcatagccgggttgttctgcgccagcgctaccacaaggagtggctgcaggtccggcgccgaacccagcaacgccaacatctgggaggcctcctgctccatgtgcaactcgtcggccgactgctcaagccgcaggcctgcgaagagggtggctgatggctgcgtgtcgtcagcgaggacggtagcctgcagcccctctccctcgagaatctgctggatatcgccggcgaggagcgcgtcgtcgctgaatacccacaccgggcgcgtctctctacctccatccatcttgtcctcaacgttttcgaccagcgcaccgatcgatgctaggtgggccatcacgtcgtcaagggccgcgcgggtcaatccgggcacccgggacacgatctcgggcggctgcagtccttggctcaacaagtccaaggccggccacagggtcccggtggcgtcgtcgtcctccagcgttgtgctctcggcgttccagacgcctcgacggaactccaccctgtccatcgagtaaggcaccatcatgaggcccggtgaaatgtggttggtcactttggctcctgtacagcctaggcttggacgcccacggtcatggtgtgggtcgcggtttggaaaatcccgtcgaggttgagtgcctgattgagttcgtcctcgtagaagcttgaggactcgactgaggcaagaccgagccccgtgcagaccaagttgatctgttgtgcgatcgccccgacttcttgaagggcgaacctcaaacccctggctccgtacttccgcatcgccctccacggcgagatgacgaacaccaagtgcactccggccgcatccgattgctccacggccggctcgccggccatcgaattcctcacgccgcgacagccctcttcaccggtcacgggcaccagtcgatcgatgaccggcgagtagcggtagacgccgcgactcaagccggacacccgttgtgcggacatgaagatagacacgggatacagccctccaccagacgggacagcgcgtacattataccgcacgatatcaccgctcgaacgtgggacatccacgtgccccgtcacaccggcagcacctctcagaaacgcagctacgtcacgcaggtctagggattcgccggtgtagttccgtccgctgcgccggcgggcgatcacttgctcgaggggtgcgcgcaccctgctggacctgggaagttcgatcacatcggcagcgaacgtgtcgcgatccatctgtccgtacgtaacgatcatggggtcaacgaaatagtcgccgaccgagacgttgaactccatatccccccgggcgatgcgcgaggcgagcaagaagtctgcagctgcgttagacagccccggcccatcagtgttgtcgcagcggaactcgtgggtccgaaaccccacaccttccgtgcccgggctctgcgctcgatacgacgtgatcgcagaactagccttccttaaaccgcccggagtagctaccatgaccgtcccctctgaggtctcccgaacacttgcgacaatagcagcatgtgggggcagccgccagaggcgggcatccttgtctcgacaaccattgacctccggattcgatatgtgcataatcatagtcgtgccaacacgaaacgtgtacgtctcggaagacgacctagacctgttcgccgaagccaccgagatcgctggaggcctgtccgcagcggtgttggaggccttgcgcagctacgtagacaggcaccatcgcgcggccggcggattcgacgagatcgagctggagctgcagaacgacggtatcgaccaccgtgtcaccttcatgggtcgccgcctgatacacatccgccgtccagatcccgagggaacccgcatagacactgtctacttgaccgccaaacaccaattcgccgttgccaccaaaatccaacgacggctgccagactggacggccggccacgagcacatctggtccgacccggagacctggaatcgggagttctggatcgcaggtgacaagacgatggccgtgtatcccagccttgacaaactccgcgaagctgaccccaatgtggccgaacgcgccgaggccgcggtcaaaatcccgccgttcgaggtcctggacatctgatgacagaatcatcatcttcccggcggcaattggcaatgccggtgctgtcagtcacggatctagccaagaaatacgtggttcatggcggctacgaggtcccggcactcaacggtgtctcgtttgacctgcacccgggagagatgctgggtttgttcgggccaaacggtgctggaaagacgacgctggtcaggatcatcgcgggcctcttatcggcagattctggagacgtccactggggatcggatcaaggtcgggccaggttaggctacgtgtcccaaaagggtggactgcagtacgggctcacgtgccgggaagagatggtcttccacgcacaatgcttcggccagtccgccaagcaggcccggactagcgtcgacgaggtcgccgcgatgctgcactgcgattacctgatggagtgggacgtcggaaggctctccggtgggcaacgccgaatcatcgaggtagggctagcactcgtcaatcaaccatcggtcgtcctgctcgacgagcccaccctgggcctggaccccgcaacacgcctgtcgttgtggcaaacggtaaagtcggcacgccgtgagaccggtgctgccttcctcgtcaccacccactacattgacgaggtggccgagcacctgtccaacgtcagcgtgatcaaccacggaaccgtcgtcgccaacggctcgccagcgcacatccgagaaatgttcgcgaccggggaagtaacgctcggcgtggccgaggatacggtggacagtgcggtggacgtgttggctgggaccgcgttcgaggcgcaccccaccgaaaccgtcccggggatcgtggtcaggtccaggcatcccgacgtggacgcggccaagatcatcaccatcctggctggtcatggcatctcggtggactccatatccgtacgcgaggcgaccttggaagaggcgtttctcacgatcacaggcagtcgagacccggagaggcaaatcccatgaacacttgcttcaggcgatatgcggcgatgtcgctgagagcgcggcgtgatttggccctgacattcatccagcccctcgtctacctagccctcttcggaccgctcttcgtcacgacgatgaagatgtcgcagagagctaccgccgctacgggttactccctatacatcacgggcctgtccatccaaatggccatgacgatcggtgccttcgcggggctaaccatcatcctcgaataccgactcggcatcctcgaacggatctggagcacccccctcacggggagcaagatgatggcggggcgaatcgcgcgcgacgtcgttatgatgatgatgccgatactggtcgtcttcatcatcggcctggtgctgggaacacgccccagcccactgggcctggcgacctacttcgtgacagtgctcggcacaggagccacgttcgccggggtctcctacgcggtggcactcagaacgaagagcgaggcagcgctatccgcgatcttcaacctcatcctgctacccatcctcctgctgtcggggatcatgctgcccatgtcgttcgcaccacactggatcgccaccgctgcccacgtgaacccgttgtggtacctggtgcaaggcgcgcggaaccagttcagcgttctagggctcgtggcggcggccccatggagttgggctgtggccatcgtcatgtcagccgctgccttcggctgggcaagccacgaattcaacaagaggcgctgacacaaagaatggtgccgggaacccaggtccccggcaccaccgagtgcactcgcgacgtcaacgcaccgttgcggtcactgcgcaggtcgagcacgaggacgacgagcccgcgctgctgcaggtcgagccgccaggcgcgagcaggtcgacgttagcgtcggcgccgccgaagacggacgtgacggccggctgagaggtgcggatgcggtgctccagcgaggaggtggtggtgagtttcatgggaggtgctcctaggagtgagacgagaacaaaccctagcgataggttagcagtccgcaaccgactccgggaatagtagaagcgcgcatccgtagcggaagaccttagcctgattacagtgaccctgttcgcgtctcaacattattccacacccccgagcagcgaacgacaccgcgatgatgatccgtcgcctctccaccgaagaactccgcgcccacatcgcaccgggccgccgtcccgtgcatcagacctgccgtcaacgtcggccatgaagctgggaaggtggctctcgtctaggagcagacgcgggacgcctcctccaggttgggccggggaagtgtccggttcttgatgtaggtggcggtccctattgatgggcgttgaccgtgggaatgcggtcggcgaagggggtggcgaacccgttgagcgcaggcttccagcgcatgcatcaacgctgtctgccggccaccggcaagcctcacccgcccgtcatggccatcatcgaggtgccggtgaatcctcgacacatgatcccaactcccccggaggggcttccggggctgttcagccaccagatcagccaggcggcgagcccgactctgccacccggaccctgcagagcgtgcctgctgccgtcgtgtcgtgtcgggccagtgggccaccagatcggccacatccgtcttggcccatctccagcccgccagacccagggaggccatcacctcatcgacgccgcgccgggtggtctcatcaaccccgtcaaacagctcgggccacctcgatgatgccgtccgtgaacgatccagattcatgacatgctcctcttcacagatgccgacgacgatcaggccgtggccgtggcaacggggtgacctgccggcgcggctcacgacgttgagccggaaccacacgagacgcaccagtgtgctgcgccgtcttgagtcgggcgctgtactgggccctggcgctgtggtgaacagcccgacgaagcaccgaccgccggctgtcctcatcgccagggcgaggcatggggcgcggcatggtgcgcccggtagcagcatccatgagggtgatccggtcagccaaaatgccgagccggttttcccacttccggggccacggcaccagcaggtcacgctgacagcccacgccgtggcgtcggcagtccacaacattttctcacggccaggatgcgagtgcagcagctccaccggaacaccagcatcacgcacccgccgcatcgtgacctcatcctcacgtgccaccagcgggggagagcgactaccgctgcagccggtccaaagcgactcttcacagatgagggggtggatcggtagctgacccctaggtcctgatgtgggtcgaggtccttggaatgatggaagttcctacacacccatcgccaaagacctcaacatggacaacgctaccttcaccactccctcatccgtgaagagccagtttatgcacggtgttgaaagaggcgtcggtctacgacgaatgcgggttaatggtcttgcggtgtggggcgctgggcgatggcatcgagaacgcgtgagtgggtggcgatccattcggccgcgtcggggttgatgttgcgggcgacggtgtcgatcgctgttacgtagtgggcaagcctgcgaatctcagcttgttggtcagggtgatcgctgatgagaggctcttgatgggaggcgcggttacggacgtggcggatgagctccacgttttcctcgaagtcgcgtcggctacgccccgggtagtgaggcatacctccgttacgtaagtcagtgagagctttccatacggttgcttccaggcgcggggtgagcagaaagcgccagttgtccagtgacagactcgccacgatctgatcaggggtcgcatcgagcctcgcgcgccgcagtcgcttctcggccctggcgacgttacgcgggaaaccaccgagccgatagctcggggattcccaccaacgccgtatgccagtatcggcgctcaggcgcacgtcaatgaagtttctcaggagtacctcgacatggctgatgtcttccaagaacgctttcgagatgcgggtgttccacacgtaccacgcatcgactggttcgatccggtagcggctgagcctggcgggtgagaaccactcctgcaacgtctcacgactcaccgtgggagcgtggtaggattgatgacgataggcctcgggaaggtcaatgccgcgaaatatcggtatacccccgaggccattgtcttgcccaggcccctcctcgcatacttgcggggcgtcattggctgccgtcatctcgtctcttcccggtacgtggctgtccatgttcacgggcaggtacggcaatgaggttcccgcacacaaacctctaccaagcatacgctggcaagcccccctctcggccccaccacaacatcaattgctgactcgaacacctttgaggcagcgctttcggcttgcgcaaccccacccacgacaccgtccgcttactactcgaagctgagggattcagaccccacctacaccctcgattgtgaagagcctccaaagcccgatacaacgtctggcgagacaccgtgaacgacctcgccaccgcagcaacgcaccagcagcgcgggatggcttggtattagcccagcgcagggcccccaggcaccagccctaacgaccccgcacccgacgtggctagaggataagccgcacgggaggactccatacccgccgactcattccagcccgccaccagccgagccatatgatcaaccgcccgcggtaaataatccagccactcacgccggtcgtacaaggaaccggccccgctccaggcgtgtgcccaggatcgccacaacacgtcgagctcgaccaccacgcccggaatagattcccactccaaatccggatcagcggccgccacgtaccagatcggccacatccgtcttggcccatctccagcccgccagacccagggaggccatcacctcatcgacgccgcgccgggtggtctcatcaaccccgtcaaacagctcgggccacctcgatgatgccgtccgtgaacgatccagattcatgacatgctcctcttcacagatgccgacgacgatcaggccgtggccgtggcaacggggtgacctgccggcgcggctcacgacgttgagccggaaccacacgagacgcaccagtgtgctgcgccgtcttgagtcgggcgctgtactgggccctggcgctgtggtgaacagcccgacgaagcaccgaccgccggctgtcctcatcgccagggcgaggcatggggcgcggcatggtgcgcccggtagcagcatccatgagggtgatccggtcagccaaaatgccgagccggttttcccacttccggggccacggcaccagcaggtcacgctgacagcccacgccgtggcgtcggcagtccacaacattttctcacggccaggatgcgagtgcagcagctccaccggaacaccagcatcacgcacccgccgcatcgtgacctcatcctcacgctgccgatcaccgtcaaccagatggtcagccacgatggtgttcacaccccatgactcatgcagttgcctggccaaggcgcccaacacctgctgacgcacctgtgacttgacgtcatcatcctccagatcctgtgtaccaaccatcacggaggccaacacatcactgcgttgctgaaccagggtgttgacgacgtcgacatcgtcgatacccatgggattgttggcgcgcgcggccacggcatgaaacgtgttggactgcaaattctcgaccagaccacgccgatagtcgttgaactgggaggtgtcggcaatgacaccggtcatgatgtaggccgacccctcggacaaggccctgtaggactcgtcgacgaacgccaccaaccccggccgccgccggtaaagtcgacctgcttcctcgtcagccagcaaccatgacagtttttgccccatatgtcctccttgctgacatgacctcgaacatggtaaactttccgtaggaaaaacggggcaagtactttcgagcggctacctcggcccccggtgggctgtccagccttgtgcggaccgaagccgggggattccttatgtttgcggcaatgatgccgctgcaccccctcatgccgtggtgtggtcctttccccgtgtgcggtgtggtgcgtcgttgactggtttgtggccccgagccttactctgaccggtaggagaacggtgtggggtctacggatagcccactcggctcccggtggaatgtccaacagggtagggttgatgagttggtccatcaggaccgtcccggtggctgcgtcaatgatcgatatttcgatgatgcgcccgtccaggtcggtggtttcggtgtcgaggatgactccgactccgggttctaggagttggggatccaatgggtggtcatcgtgtggctcctacagggagtgtctgggctggacagcggtgcaatacccgcgccatagcggttttttctgcgggggtgacccacagctggtatttcgttttgacggcgatttggcgggccacgtagtcgcatctgtaggccttgttagggggtagccaggtcgctgcatccctgtctcgtttggcctcattagcgggtccgtcgacagccagcaagttcaacgggtcgttggccagggcggtgcgttgcagcggtgagagtttttgcgcgccggtaatccacgcgttcccgagggctacgacgtggtcgatttggactgttgtcgaggtgtgccggccgcgccgccaggcgagtgtggacccggtgtaggggtcgtggagtcgcccggagacgaccacgcatcgtgatccgggtttcaggtgggcctcgaccaggtcgcgggcaagggcatcgttgcgggtgtcgcatccgttgtggccccaggggcgggtcaa

SEQ ID NO: 31 - DNA, 56169 bp, Propionibacterium acnes
tgccgacgccttcggcgtcgggtgagcgcgtggataggcgccccttcggggcacctgtaagcctgtatcgctgcggtttacagccttggccacccaaaggggcagcaaggggcccggagggggcattctgcgccgctgatagcatctcacatgtgagttattctctcaactatccttcaagtcaagcgtattagattatttatctagtactcttgacagtccgtctatcgggctatatatttataagcagaacgagagatcgggaaaggaatcaacgatgaagtacaccgcacacgtcaacatggtgaccaagccctacatcggacttcccactacccgaaccccctacaccctcgtcgacgccgactgggccacaacatggatgatcgacgaaacctacgaagcccactaccacggcaccagcgtggagatcagcatctacggcgaaggccccaactgctccgtactcaccaaccgcatctacaccgaccagcccaccgatgtgaccgctgcactcgccaactacggcttcaccatcgacaccaccaacacatccaaaaccatcctcacgctcacccgcacagccaccatctcccacctactagccatcctcgatggcctaccccaagccgaggggactcactggctcaacactcaacccgacctccaccacatcaccctcgacgactccaccaccggctgggccaccaaccgcaccgacgacaccgacaccggcgtctgctacgacaccagcacccacaactggcagatctgctgacagcataacgggcctgcccttgaagggttggactctgcacccatttcagccgggtacgttgccggctgggcgaaggaagcagacggcgccgcgattgaagctgccgccgagcacgtcgcgaagacctcccacgcgattgccgaggcgttgcagctcaccgcacagtgagccccacggggcgaccggctcaccccggtcgcccctcaccccccgacaggggaaccgttcccgccgcctgaatctccatacccctgatacgtactacgcggggtcgaggagtggactcccccaccctcgtgtagtacactatactacacagtcattgaggatagaggtgacgtcatgagtttttcgatccgtttaaccgaccatgagcgccgcttagctgattcctacgcccgcctgcactcgcagtccctgagtgaggctttcaagcaagccctcttcgaccgcatcgccgacgagttcgatctgcaagtagcccgtgaggcactcaccgactacgcccgcgacaactaccagtctcgccccatcagcgagctatgggacgagtgtgacctatgagctggcagatcgaaaccacgagccggttcgataaagaattcaaaaagctagaccgctacacccaaaaactcattcacggctggatcacgaaaaacatcgacaacaccgacgatccccgccgccacggcaagcccctcaccggtgatctttccggactgtggcgctaccgcatcggcgactaccgcctcatctgcacactcaacgataaccgcctcaccatcctcgccctgtccatcggtcaccgccgcgacatctaccgataagccgttgcaagactgcggcgtcgacaccgccgggaccctggcccaggccttgggcctggaggaggacgagagcgaggagcacgccgcctgagcggtcgccggcacttcccataacagcaccggtcccggcggcccggccccgcgtctggtgctcggaccgatgccggcgcctggcctccgacgcccgccggggccagcggctgggctacctcgacgtcgacgtacaacgggccgaacgaaccgtgcgctgatttaccaccgcttccgcacagagaacatgcctctgactaggagaaatgacgttttccacagggcctctattactaatatccctattatctctatccacgcgcgcgagcctcagcgttcaagcttcaggtcttgctcgtctccctcgcgcctcgctgcgctcgttgctactgccgccccacccggcaagccgggtgggttgccatcggaataccgtggaccatcccggcgcatacacccagacggtccaagatccaatccacgctcacccgcgacgccgctaacgatcctcatacaccgtagatgccgttctgagagccttccagacccgcacgtgggtttattgcaccgagacccaaatcccctcagaagcgatcctgaaaccgtctacgccccatttccgacggacgctggacaggctgggcggcttgtctcccgccgcagacatggccctggcatatgcggttgccgactggtgggatcagggattggatcacacggcagacggctggtccaaggcgggtgtgcaggtgcggtgagcggcagacgtgaccggtggggtgcactgtcatggccgggcatctgccgagccaccatgcgggccctggaccaggaggcagcccgctgcgaggactgggggaagacggcggcacggatgggccgtcgggatgcggcggccgaattcaccgagactgcggtgcagcatcgtggacagatgcaccacctcatgtcggcacaaaaagtgtgggtgtcgaccgacatggtgtcggctacactggacgccgcaggagacgtgccgagtttcgaggccgtcgacgtccctgccgccgggctcatgggtttggccagccccctgccgccggttaccctgcagcatccgctgtatctgcgcagcgacgagggtgtgacaaccttcactgatccggttctcgtcgacgcgctgggatggtggatggattctgggcgtgtgcacgtggtgatgtgcacacgcacaccccggctgcccaacccggtttatgcggtggcctccccactgacggtggtggagaaaatcacggtgcccaccggcatcgagttcgagaccatggagtccaggatcctgacccccggcggcgtgacaggcgtctcacggcagggcacacgcatgatgatccggttggcgtcatggctgggtgccgcgtgggtgctcatggcgactccgacggtgtcggagccgcaccctatggatggccggtggggaggcccagcaacggggcagacccggccgcgtgatcgggtgaccgtggtcgacatgcggcccatgaggcaggtgcacaccaccaccgaccccaccggcaggcggttgacgacccggcatgtcgtgcgaggacactggacacaccaaccctacggcccggcccgcagtctccgacgcctgcagtgggtcgccccattcatccgcggccccgaaggggctccgttcgtcggcaccgacaccgtcaccgtatggcgccgctagatacgcgggcgcggggggttgacgaacgatgcccccctctttgtgttgtgatcagtcgtgatcggcgggttttaggtcggggtaggtgtcgagaatggccttgaggacgaggtcttggattgtggtgtcattctgggctgccttgaccttcagtccaacgccgatgtcccgggggattctggtctgcaacttgaacaggtctgcctccttggttttgaacagtttggctgcagggttggcaacgggctgttcttggcgctggcgtccaaggttgcttttctttcgggcggtcatgacatcatctccaacagttcgtcggcaacatcggcgaagaaggcgatagtttccggctcaggggtacagccgtaggcgcgcttgatgacttgacgcttggggatgacgtgatcgaccaactgcgtctgggagtcgttggctagaaggtcgcgaccttccttgaacagggaggtattcggttcagctttggaaagcagcaccacgcgcggggttcctgcggcggcgtcgtgcgtctcccaggtgcgcgccatgtcgagcccggacgtgtcggtggggatgataaccagatcggcggcgcgaatggcggcggtgatgatgtcaccgttgcccggcggggtgtcaatgatgacaacttcttcgggtccggcgacgaggtgctggagcgtcgccttgttggccggttccacggggaaccccaaggggtcggcgttactcagtgtgcactcggcccaggatgatgctgacccttgagggtcggcatctttgacgcggaccatacggcccgtctcatggagagctgcagccagcaggatcgctgccgtggtcttaccgacgccacccttggcgttgataatgctccagatcatggtgacacctttcagtgaggatgcatatcagtttacctgcaaggagtaaagacggcaagcagttatgccgtttctgcggcaagccgtcttgcatccttggatgtatagatagttgtctacttatggttgtggatcgtggtgtctcgtaccaggatttagtgtgctcgctgatatgcacgactttcgggcggcctgatctggcggtggtgccactaacccaggagtctgatccgcaaggtgtcctcgactttgaggaaggggtctctgctttcgtgttgacctaaagtcaacggccctgggcgatcactgaatcctaataactttgtatccttccctgattgcatcttagcatccttgaattcaaacagggatggagccatgctgttttgacgacatggatgcactggggtttggttgttgccgatgcggagcgtcaggcggcccgggacgccgccaccgccgacacgctgcgggagatcgtgggactgctgggccggggcggcgaggtcccgcccgccaagacggggcgtaagacgaccggcaggccggccccggcccgcaagtcgtcggccacgcagtaaaggcagggatccgtccctacgcagagagcggaggcagatcctgggggatccgactcttcggttccgtgatcttcccggagatcttcccggatcccccagggctcatcctgatacggggtccgccgacggaccccgtatcagtgggggcgctgccaccagtgatggcgggcgggtcggtcggcgtctaggccccgcccgatggtcgcctggtctacctcgcaggcccgtgctgttgccgaggccgagaacgtctgcccacttgttgccgattcagtcccctctccgtctgccatgtcgccaacctttcctatctggcgtgctcatggacatgcccgggcacgccctcgctgctcagaggcctgctcgttccacctctggccgcgaaccgtatttctgctgaccactcctcgtgcgtgaatatttgccagccttggccattcatatttggactactctgcaccagatatcggactgggaaacctcttgcacatctctaattgtcatctattcgttgggcgcgcgctgttagatcgtgatcataccaatcagaagacaaagcgacgcccttttgagcggcttttcgaacgattctagaccgcgctatatcagcatttctaccgcgcggccagagtgctacactaaattcctctctgcaatccttaagtccattctttacttcctcatccaatttctgcgacagcatttttatggaagcatcgcactctgactcatcatcaaatgcctcaattgcgtgcgttcgccattcacggcgcgtattatcgtagccgtaatgaagtattacccaccgatccacagaatcatcgttaggatctacaactgtcatgaatggcccaactctcgctctggtgtattctcaattgcagttcagtgactttacttgaccagtcccggatttagtagacgtagacggagagtaccccgccgggaacttgactgacatcactgctgtaccgtactgctttcccgggtggcaaccatcgtaagcagcatttgccgtgacgtacctagtgctctttctctgagtgccggtaatcgccttatatggtacaggtgggtgaatcgtagccgttacggctaccgatgacacgtttgcatcacatgaagctgtggcgacataattagttgtcccattgacatgatgagagtcgtggacatactgtcgaggatcgagagtgcaggttattgttgacgccgttgttctggtaccagctgctttcgagctctttgttgcagttacagtctgcggccctgaaggttttactgacgcgactgatgtgttcgcgtgttttgcggcagtgctttgatttggttgtgcttgtgtagcagttgctgatgtcgccagtgatgcccccattaccatagctgtgattatggcgtagtctttacgcttcattgcgcccccaaataagcatgttagtttgctattttgaataggaaacgagacatcgccatgacttgtcaagggcagaagtagaaagaatcggggggtatcaagaaagatgtgctttcatcaggacgaaagcggatgggtccgttcgacttggtgacgaatgatccggccttgcgtcgcggagaccaggccggcgagtttgtcgagcagggccgccgtggcctcatcgtcgggcacatcactaaagggacgaacaaccatgacggctagggccagaaacgaccggaactgaatcgcatgtggacccccatctggcaccaggcacacacctaccgaccggaaaccctgcaccctgtcgctcccagttcacctcctaatatgcgcctatagtctgtgctagtagacattattttgtgtgttgtttcccatctggcatgtctggccccggacccgccgcgacacgcggtggtggataacagaccaggacccccggaccatagagaccagggggacgagacagtcccccggtgaggatgtctcgatgtgcagatcaggaacagaatcgccgggcacgacccggcgccggtgccggtgcagtgaacccgtggcccatcgactccacgaacgaacgtctcgccttcctcaactggtgttggcggcaaggctactcagcagccatcgtggaaacgatggacgccgcgggagcctacgaccacctcgacgacgaccagaccagcaaccagcacgactaacgccgctcccagcacgggggaaggcggcgcaccaggtgcgccgccttcccccgtgctggtgtctcgtcggcttactggtgggggtcgtaggggaacccgtaggtgtgttccagggccttgcggagaaggtcgttcatagttgtgtgttcggcgacggccttcatcttcagcgccgtgtgggtggcggtgggtagcttgacgttgaacgcggtgatcggggtcttggccgactggaaggtttcagagacactggctccctggctggccgccatttggtcggcgtaacggctggctttgtcggcggcggtgggtttgcggttcttactcacttcagcatctccttgattcggtcggcaacctgggcgaactctcctagatctgttggccgggttccgatggcttgccgataggcgacccgtcgatgaacctccgcatcgagaacgtctaggccctcaacggcggcggccccctcgtgggcatcacggtattgcctggtccaatcggctttgttgaagagcagggcccggcgtgtgccgtgggccacctggtaggtcattagcgctcggtccatgtccaggtcccccgactcggtcgggatgatgaccacatcggcgatgtcgagggctgcggtgatcgtctgagagtcaccggggggagtgtcgatgatgacaaggtcggcgtcgatgtcacggcagcgcctgacgataggggcattagccgggcggacctcgaagcccagcgggtcaccagtctcgaaagcgtcggtagcccatgacgtcgccgatccttgcgggtcggcgtcaagcaagatgactcggtactgagctgctaaggccgttgccaggtagaccgccgtggtcgttttcccgaccccgcccttggtgttgacaatagaaatactacgcataaatacatcattacacatgtgcatcgatgtatctgtatatatgtgtatcggcgtgttgtgagggaaaacccgggccacatacaacgatcccccagccaccacagccgggggatctctcagtaaagccagcaactcccacagaagttgcacccccacgatacccaccacatccgtgtcaagcccccacaacacccaccagcgccctaggcttcccccatgaacattgacatggacacaccaaccgaaaccgaagccgacaccttcgatgccgtcctcgccgacattaaccacatcaaccgcctcaccgccgacgaaatcgagtgctactccatgggagcctgtctcctcctcctcaaccaccaccccttctccgaactccgccaacactgggccgacaaccccaccgacgaaaccacgtggaccctctacggggccatcatcgccgcctccaccctggacccccacctcagcatcgacgccctagcccgcctctaccagctccccctcgacctcgtgacccaagccctcaccgtctaagcgtcgatgagcgggggagaggtagcgcactatcggctaaggaaccccacaaacaccaaacccttgtcactgggaagggtttggtgttatgctggtctcacaactcaacagaggaggtgagacatgggaaatgagtaccagaagtcgctcaaagtcctgttcaagaaactggaatctgagcaaggagcccgcatcgagacccggcgcaaaggatggatgatctacccgccggatacgtcacgatcagcggtcatgatccacaagactccatcagatcgcagagcatgggccaacatgctttccgaactgagacgctcaggattcaccgtctaactcagtgaagggggctggagctccagccccctttcaaccacctcccccggacaccacacaagaaaaggagaacatgatgtggcacgttcggttgtcgcttcgcgcaatcagcgaggacatgctgttcgacgccctggacaccctcgaccccttatccccggtggccacactgggccccgatgagcacaccggatcattggcggtgttcgtcgaggctgactcactgacagacgccatcgagactgcccgcacagccatcaccaacgcatgcaacaccgccaccataaccggcgtagaagcccgccccgaagacgaatgcttcgcagacgttgaccggcccctgttcccgccagtggtcggatacaccgaaatcgctgaaaccgcaggactctcacgtcagcgcatccgccagctcgcaggcaccgccgggttccccgcacctgtcatcaagaccgcggccggcccgctgtttcccaaagccgccgccgagcagtgggcgcggacacgccagcctaaggcaggccgcccaaaactccagaccaccacctcataacacatcccgtgtgctgaacctgttggccggcccagcacacacccccaggggccgggcccagcccggccccgccccacacccaaccgccccctgttgccgccgtggcgaaacgatcaggcgagccacgaccatcgccaagctgaatggagagcgagcatgagcaccacccctgccgggttcgacttcgacgctctggccgagtgggccgagagcgatgaggcgacccacaccccgcaaaccagccccgtgttccggggcaaggacgccgcgcgcgccagccgcgcattcctcggccgaggacggcccaccctcggctcagaccacgccaccggcgagggccggtcgccccgccgtcaggtacggctcgacgcacgcaccaacgcgcgactcgacgcctacgcagccgcaaccggcaccagcgcctcccagatcatccgcgacgccctcgctgactacctgcccgcctgatcccaccccaatccactcgggcgcctgtcagtgccccctcttctgggtggtggtccggggcgtcaccgccccggaccagttgggtagtcatctcagttgaaataagcgattagtgatacgcccctcatgctttccggtgctgtcatgagcgtctgacaacagcgacacctcggggcagccgacggacagtcctctggctgccgctctgatcccatgcccacggcacgaaggtgtcggacagctcggtctcgtcatgtgcccaaatagcgtcgtgggcctgtcgccaagcttctcgggagccccacacgggcacgaccgggccacaccggtgtcctggtctccagtgtcgcgacactgtcgatttcggtacgtgcaatgcggcggcggtttgacggatcgacatcccagactcccgcgcgtcccagatcgccatgtggagagtatttgcctccagtgcggccgccacacttgcacgctctcgcgcacgctcgaatgcccgcctagtgctctcaaatgtcgtcacgacgcctccccctgaaaatactcagggtgtcccacggtgggacaccctgagtatttcataccccaactcgcctcaccacacgtcgacctcgacaccgatcaagcgacccgtatcagcgacattgccgtaccgctgccccgcctggtcctccagccacgacaacgcatcccgaaacagcccgacgtcttccaaagctaaaccacagtcgtagccgcccttgtcccccaaccgcacaatctggcgctcccggtggcctccctcgtcgacctcgatccacagtttcgcgtgcatccgctggcctcggccctctgacaggatctcggtgagcaggtcggacgcctgccctcgcgcatcctcgttactgcgggggaattggagtatgtgggaggaacggtggtggggcaggtttgtgacctcgtgacgcagcaggttgcgcttgtgcatctgccgttcgagacgctcgggctgacctgttgacggggttgagccgtggcgccgcttcctcggcggggtctcgatccgttgctcttccggcggttcggcgtcaggttgtggtgcgcgatctcccctaggacgggggggctcgccacctatatccgagggacgatgagacggccttccacgcttgctgcgcactttcgcagcccgccccttgcggtcacatcgacgcggcggcggagtgacgtcctcaccgcgcgctaactgcgtcaacgccgccaccaggttggtgcccggtttcagccctttcagcacgaaccgcaccaggcgggggtctcggccgattcgtcgggcaatctcggcttggctccacccttcggctaacagggtgcgcaacaagtcttgggcccggttatcacgctcagtcactggtcgcctcctcggggagtcctgcctgctcggcctgctctgatagagcagcccgttccgatccggtctggggcgctttcaggggaccgggtaggacacctttgacacgcagtcgcccgtccttgccgtcgtcgccgcccccctgggccacagggagcgcccaggggggcacgttgctggtgtagatggcgtcgccgtggatagccagcagggtgcgggagttcatgcgtagtgctcctcccttggttgtggcgttttttccggtggtggggtcggcgatgggtgtgttgagggtgcgtacgcgggacagggcccagatacgggcggcgatttcggggtgccaggtgtcggggtcggggcggcggcgggcggtttggtattggtaggcgatggtgtcaccggttttgttgcggatgacgtcgaagccttcgatgtcggaggggatgtcgtcggcgtcgtagacgacggtggtggtgacggggttggaggccgacatttggccgatggtcacgcgcagcatgtttttcaacgcggaggtgaggattgtcgtggcggtggggttcttgtctgcccagcgtttctcggcgatgtcgatcatgtcttggatggttttgacccatcctcggatgggatcgactttggtcagtttgatccctccaaggaactcgatgggcttagtaacgggcccgtcaggaccgaattcggtgtcccagccttcgtcgatggctagtttcagttcggcggcgtcaacccatgtttcgtgggtggtgccgggcacgttgggccaaaaccatcctgctcgtcctttggtgcgtttgaccggtagtaggccgatgtcgtcccaccaggatggcacggtgaagcggatgtggtagcgggccgggtgccaggggttgttggtgaacaggtcgtgagcttcggtggcgctgagcagagtggcgggtgcggcaccgatctctccggtcactgatccggcatacatgaatcggccgtcgatgtacacgaagttagggatagggccggcaggcacggtggggcgccaaccttgttcgcggtcctcggggttgccgtcgtcgacgcatagttcgtagcggtgctgaggggaggtgtgttggatgagtgcgcccagttcggggtccatcggctccatgcgataggactcgggggtccgtagcttccagaggttgattccttctgctccggggcggtccatgagggcccagtcgcggtcgattctggtggcgatgatgtgggttaattcgcgccatgcccagcgggcctggattggggtgagggtctggccagggaaccattcatcagcgaccagaatgtcgaggttgcggtcggtttctttgtgggtgaaccggcctcgggcgggccgcccggacagcatgaacaggccccgcacgtgccagtcctggttgaactcgcgggtgtgagcgggggtgtcaggcagcagccaggattgaggctggtcggggatgttaccgcagacgatcaggcgtcgggcgttgtggtgtagcgcggttgttagcaggtctgacagggtcgcgtgcttggtgcgccgcccccctagcactggcaggatctcgtttccggccgcgtcgactccccgggcggtgtcgatgtctagccacactgtttcggggtcggggggccgatgtggggcgggacggcgctgctcctggtcgtctctcatggtttcctcctttgggccagggagcggccggcgtcgagggcgttcatgcgctcgcgttgttcttcgcgtagttggtagacccggcctcgtgacactcctgctgcctcggcgatggtggtggccggcaggtggccgatggcggcagcgtcggcaaggacgtcacgccaggccaggtcaatggttcccagctgggctagagcttcgtcgcggcggcgggtggcatcagccactacggaggcccaccctgtggggtggatggtcttgacgacgattcggttgtggcggatggggccccatgcatcagcggggacttgccagccgtgattggcggcggactcggtgatcttgaggcgtcgctcaggtgcgcgggtgcgggcagtgacgtcggtgttccaggtctggactggtacccacgtcccctctcggatgcgttcgatgacgcacgtggtgacctcgtcggtgactgtgatgaccagacgataatctttcccgtctggggtggttcggtagctgggcatgtcaccctcccctatctgtcaaatgagctagacacagtgtctatttaatttgacgcaaagtcaagtgcattagacgcctttgtgtggatccgccccaccagacaaacactcgcgcctcatgacccgccgcgaagccttaacgaaaccaaaccgcttatagaaccgctccgcagcgctccccgagggctttagctccaaggtaagaccttgctcgtcggcccattggcagacttgtgtgaggatctgtgagccgtagccctgatttcggggggcggcatgcacgcacatcagcatgtgaccatgacggcgggtcggcgggctgacataagccccaccacgccagtccggtgtgatctgccaacttcgccatgccgcagcgcgccagcggcgggcctcggtagccaccatgatcaccatgatgatggacagggttacgacgccgactatggtcagctcactccagccaggccagttcccggagatgatccagcctcccagcgcccagatgatcatggcttccacgcccgccgcaatcgggacgagtggggcagtacggatgcggcctgccatgatctcggtgatctcgctgcgatgccatgacaaggagaattcccacgactcttgaatcatgctgatgtgtgaacggcttcctcggcttcgccctgccatagcttctctagacggcgctcggctagctcgtcggggcacggcgacagcctgccgcactcggagcagaccccgaagtggcgcgagagagtgatgaccggctcatcgggagcatgaaccgattcaacgaccgggtgctgctcatcggtgagtcctgaggcgtgaccaatctcggctagacggaggtgaaccataccgtcgtagtagtcgaggccttcaacgtggaacgggtaggagccgtccgcggtgtggcctgcaaccaggtccccgacttccagctgactggcggtcatggttcgcaccggcggcagcggggtccgggtcgcgttgatcctcatggtctctccttgcttctgcgccttcatagatgaaggtgccacagccggggttgatgtgcggaaccacagccactttttcaataaatccatcaccacggtctcaccccttcccaaatgtgtaaaccgtggtttacgctttaaggcatgatcgaacacacaccgacacccgccgcgcctcgcgtggccatcatttcccctagcgggccaccacggttcttggccgagcctcccagcgccgcgctgcgacgccatggtcggacccgcatgaggtcccttcccctatcccctcacattcgcgcctgggtctccaccagcggccgtaaacccaatcccatagccaccgccctgatctggatgcataccggagccctgctgccggtgtgggacaccgccgttttgactgggcctgccctcggcagacgtgtgcgccctctcagcagtgacgccgaactgacctctcggcggtggctcgaccaggttgccgaccatcccggctttctcgacacccttatcgaggccgcccgcatcaccgatggatggcatcacgcgacgcctccgcacattcaggccccttaccggacccttcatcagtgaacggaggtacaacgacatgaccagcgacattgacattgaccggacccacaaacccgacgaccgcgccgaggctcctctttaccggtcctgggccaggagactcgtgcacgtctccgggatgccctggcgtatcgtcgccgccttggccggggtctcccccacctccatgcaccggcttctattcggccgcaacggtcgacccgtggaatggatcggcatcaatgatgctcgcgccctgatggatatcggcatcgatgatctcgcctcagcgtccaccgaccgtatcccggcccgcgaatcccgcgagctgttggtagccctgcacaccctcggctggaccgatgagcatctaagccgctggctgaccagttccgacctcgacctgaccaccgcccccaaagccctctacgtcactcgactatccgccgcccgcatccaggccacctacgacatgctcatcagccagcccgtccgccgctgcggccacccccgcaccccgcccgtctcgtccccgacccctgctgtcctaccccagcccagacccaacaacaccgaaccgttccaacccgccctgttcgagctggccgactgcgcatgaggaccctgcacagacgtgattaaatcgaagggctcaaccagtcatcaggagtcccccgtgcgtttgtaccgcgctgttctcgccgacaccgacatccatatcaccatccgtatctggaacactaccgatcgtgactggacctgggccccccttgacacttgggcccccgacccggccccgaccacaccagcccagttagccgatgaacttcaccgtcacggatggatcacccctgaggtccctactaccctcaccgaggtggctgtcatccccgagaactggcaagctttcgtcgagcatgccctcgctgtccggaaccagcaggctgaccaattgcgcgtcgccgagaacatcctcaccgacatcctcggcgacgccgccgacgccggcctgtctgtcaccgctctcgcccgcacgaccggactatcccgagtcgccgtctacaaacgcagcgccaaaaccatcgactccatgagacacgccacccaggccggcggaatcctcaccccctcctgtctcacccacgctgagagaacagcgctcggcctgcccgacgagtaacccatcgtttacatcctcgactggtccctgcgaccagtgaaccgtgcccccactgcgcccacaatgatcagcacacccacggcgatcatcaggtgggcagcactaactgatcccaacgaaccaagatcaaacaagccctgcccgggagcgtcgagcagtccgtgggcgcgaagccatgctccgagattgccaatgatcttggggatcatcttgttcagtagggctatccctccgatgccgacaacgaggaagacgaggatttcttcgcctgcgttgtttcttcctgtgtttgcggtcatgctgccttctcggggtggatggccagccagctgatgaggttgtcggtgatctgccctgagatttggatcagttcgacttgcccggcctgccatgcccgcgatgtgccggccagcaatgatgctgggacccctactgcgcggccacgggatgcaacctcagccaaggcggcgcgtaactcctcgacggtgctttcgatgtaccaactgccgtcagtactagtctcagcggcatcggtggtagcgataagagcatcggtgaggtcgtcgacggcgcggtccagatcagcgatgtccggtagggctacaggagtcatggtgtgtcttccttctagggtgccttcactggtgaagggtccctagccccggccgatgtgcggtgctgtgggaaaaatgcttcccattggtccgtcttagttaggaaacttggcctaagtgctgtcgagggtcgcgtgttcgtgaccggttcgaagacactgccgccttgtcttcttgcccgtggcgcttccgagatggtcagtgggcgatggctaggccgatgagggcgccgctgcacaggctgggcgcccagggaaggaatcgggtggtgtggtgtcggaaccggtcgattagggcatatagggcgatcagggtgaggccggctatgacagtgacctggatcgtgtcgatgccggttgctgcggccggggctgcccacagtggtgtgatgcgcacatcagagaaaccgaatccgcctcgggagatgagccaggcgatcatccacgctgcgaagatgatggcggtagcgatgacagcacgtatcgccgcagtatggtccgagagggcggtaacgactacagccccgatccatccggcccatccggtccacgctaggactgccggtatccatgtggtgatggcgtcaatgacggcaacccatgccccgatggtggctagcagagcccaggccggccaggtgggtgctggggcccacgctacggcggcgatcatggttgtcgcagatgcagcacagacagcgatcaagcttcggaggctgtaggtgtcgcggtagacgatcttgtcgggattggcggtagctggttctggcaggacgcgggtgagggcaggccatcctgcgaccgcaatagccgcgacggcgaccacccacacaatctgttgcatgggtctcatcatggcccatcatcgatgagtatgggtggccgacatggggtcactcgtagaggggatcgaggggtgtgcgggcgagcatggcttcctgtgtgccgagcatgagggtgccagaatcctcgccagccgattcccagtcgacgatgacctggtcgccgtcaacgctggattcggcgatggtcacccattctccgtcgatattgatgagcaccccagcggccagctccgtggcagcaaccgggtgaggtgggttgtagaagcggtcgatgtcgcaggcagggtcgtcgggttcctcgactaccggaggtggggtcgatctggctgtctcggtgtcgtcggccaggtcggctcccaggatgcgctcccattcggggctggttttcttgcccgctgaggccatcgtctcgtcgatctgttcgtcagtgggccacacaaatttctttttggtccaggtcgtggtgtcgggtcgcagctgatccagcagttccaggtcttgcggggagtgggccttgcgggggtcgggggtgtagaagaattggacttccttgggggctgattcgccggataggtaggtgccgcggccgcgtttgccgaacgggatgcccacgccgacgtgttcggagccgaacatcatgcgggctccgtcagcggacaggggtccggtggcggcacgcccggagaagttgtctcggatttcgccgcccaggaactcggcgtcggggcgttgggtccccagatcgacgtggatacggcaggcggctgccatgcgcagcagggagccgatccagccgaaaacggggcattctccgggcatcccagagaccttgatcgttgaccaccagtttttcgcgttgccgtagaactggcggtactcgtcgatgaggaccagcacgcgggtgaagtcggtctcgcgggccccttcttcttcgatgcggcggtagcggtcctccatgagagaccacagccagtggatgagggcgacctggtcggggacggtagtggcgaccatctcgatgttgggccactcccgcaggcccaggtactcgatgcgtttagggtcgatgacgaagacgcgccagttgcggcgggcaccctcgacggcgtcgccgatcatggacaccgtttttccggtacgggtgcggccggccttgagctggtgggccatgacaccggagatgtcccagaaacaggtgttgccgtcctcgtcgacggcctgggggattttctcccagtctggggagtctgggcccggaagggccacgggtcggggcaccatcgagggcagggggtggcggcgggtgacggtgatggtgtcgtgttccaggtcgaagtcgctgcgccactggccgagcatcatcgccgaggtcaccgcggccaggcgcaattggatgttcgggctggacaaatgggcgccacgttggtggtgaatggtgaagccgtccaggttcccccgatcggttttccaggaatcgacggtgaccgccgacccatagatctgagtggctacttctttagcccgttccttgtctcggtccagatcggttttgtcagggtcaggggtcggggcgcggtattgcaggacgaaccggccggccgggatcgttgcggatgtcaccgtgaactctgccggcgaccaggcagccgcggccgcctgggtgagggccattggcatggtctcgacggcagcctcctcgggggggatggtgagggtcaggcgtcgcggatgcgtcttcttgcgattccatgtgactttctgcctcaccggcaccttcgccgccgactgaatggctaggcgagctgattcggcagtttcggtacgccggccagcgcgtagcgcccgtcgtgcgtgaaggctgcccaccacagcacagcccatacacggcagccacgagcgcggatcagcggctgctgcatagcccccggtagctagtaccgcacctgaccagccggccgcgatacttttccacgccggtttcgcgccaccaggaccagcgttatggacggtctgcttcgaggctgcggagggacgagacagcggagtgctggtcatgccgcggcctccttgtggcaggtcatttcacaggcatgccggccagcgatgatgccgtggcgcaccgccccggtagccgcatagaccgcgcacaactcaaacacggggcacccatcgcaggccgccgggttcatgctttctttgtcccacgatggtgggtcatcggtgcacggcacggccaggccatcctgttgagcggcgctgatagcggtgaataggcgcagctgggcgcgaacttggtctggggtcaggttgacggtgcgggctacacgcatggggttccttcctcttcaccagtgaaggttccctagacccggccgatgtgcggagggatttcagtgttttatcgaggtgaccagccagccggtctgcgctgcgggttcaggtaccagggtcagatgcagcatggtgtggtcggctaggggcacggcgaccaggggcccgtcggcgctcgccccggtgagggtgggagttccggccacggtggtggcgggaatctggttgggtttcgcggccatcagggagcccatgagggtcggggcggcgatctggacgagggcgactttgcgggcggcgggatcgcgggtcaaccagccgcgggtgaaggtgagcgcagccgacgtgatatcggggctcagcggggctggtgtggcggcggggtgggccgttgaggagggccatacgcgcggtagcgctggcgacatcgagcgggtcggagtggggtcaggtgtggggcttagggtccgatgtggcgatggggctaccgccccggtggtgggagacgagactggttgggggtggtgttgagggcgtgggatcagggtgaaggcagccaaactggccgggatgaggatgacggccgcgccgacacttcggagcgaggtcatgtgacgatccttcggtagctcgacgggttgccgtagatcttttccacgttgatgccactatgtgggttgtcggcgctaaccatttggcctccaccgatgtagacggccacgtggtgggcagggcttccccagaggatgaggtcgccgactttgagctggtcacgggccaccgcggtgccgactttctgctggtcggcggcggtgcggggaaggctaatgccgatacgccggtacagcgccgaggtcaggcctgagcagtcgtagccgccatcggctttgccgttgccaccccacacgtaggcgtaggagttgttgtcggcgatcgatttggcccatgccacggcttcggccaggttcttcgacacaccggtctcgttagcggccccggtggcacagttgtttgacaggtgccctgtagtagtggatcccactatttgtttggccatggtttcccatttggcgtaggcatcgggcagggctgagccttgcactgcctgagctgcctgcgtcagcggcatcttctgccagtcagcgatgtcgactaaaccgggaatgtggaatccagggccgccggccgatccggggccagcgtaggtgatggtgtggcctttcaagaacgcctcggtggcgtaggcatcattgttgacctgatccagagtcccgtaccagcccggcaggatgcgctgctgaaaggggccggcgtcaccgtcaccgttagccttcgctgaggtagggtcggccccaagatctgattcttgtttggcggtcataatagcgatgaccgctgcctgggtaggcagtttgtcacgctggaccacagtgacgatggtggtcacgagctgcttctgcctggccgtgaggcctccggcacccacagtgcctccggtgacggtacccacgcaagcatccccgccgacactgccaccgccgacgccagagttgtcgtcgagggccccagagcctactgacagcagcggcacaatgatcacggtcgcgggcaagaccgccaggcccgccagcatcagcactgctgcactcaccacggcgatcacgtgagatgctttcaacgctgcccacctttcgctggtttgagggggcgacgcctgctggtacgcacaggcttggttggtccagtccgccgttggttggcaggcctgggtttgatcggcttgctgggacccggtttgggctccggagtcttaggctccggcttcacatgcctaggcacttcggctgcggtgggaggagtcagcacgtggcgtaccggcttggtgaccttctgggcacccgaaacaaccggcttagacaccaccttggcacctttgaccaccggtgcggctgccttcgcgccggccttcttgactgcacgatgcgctttgatagccccggcctcggcccggccaaccctgctagcagtagcatcgagggctctgtggcccgtcgttgccctcaccggtgcatccttgccctggcgggtctgcttagcgatcgccgacatgccgcctcgcaatgccgaaacatgattgtgggcgtgggcgatcgccgacatgccggccgtcgcgatttttgactggccctgcggggcccctgccccagcacgaatctgctggtaagccgccgacgtgccacgagcacccgccgccattcgcgccaccttcgcagccctagtcactcccgtcgacacgccacccgtggctaccgcagcagcacccgagaccacagtcgaggccatccgccttcgacccaatccggtgagcttgcgaccaccgctgcgcaccatccggcgagcaccccgcccagcccactggccgatcaccgagcccctttcggaacgcttgctgcgcatccaatcgttgatcttgtccctcagccccttctcgcccttgtgacgacgccacatggacatcaagaacccgataatccccacgagctcgagcatgttgacaaccatgaccttgatggcgacatcaccgtcagaggcgaaaaccgacttgatgatgagcatgaccacacccaacatcaccatcgacccgacaatgccgatcatcgagtacaagatcgaacacagatcccggatgagcggatctgtgcggccagggatagcccgcaacacgttgagcatcgacatgaacgccgaccacaccaacttgcacacgtagaaccagcacatgcccgcgaacaccagcaggaccacagccaaacccgccaccgtcgacgagtaaaagaagaaccccaccaaccacgaaccatccgcaatatcgccggcgtaatccgacaacccctcatcacagtcaccaaggtcgtcgcgagcatccgagacgtcatcgtaagggccacccttgagcacctcgatgtacttgtcgtggcacttcgcatcaataatgcggccatagttgagctgctgatgaaccggcgccacgaacgagtccacaatgatcgccgacagcttcggatccttcgagtctcccgtcgaggtcatgtcatcaggaatctcgacctcaccagcggtcgccgtcgcaggatcaaccgaactggtaatcatatgagacagcgccacaccgaactgctgggtgcgagccagcggagtagccaacgtcgtcgtatcgcctgcgaacttcgccaccggggccgccaagaaacccaacgccagcgccgcagcaatcgccgcacgcgcacccgtagcccacgcccctgccgtacgtcccctcatcatcttgacgaccacgcccacaccggcgcacgtcgtcagcaacgtcaacaccgttccaccccagctgtccgctcccagcggggccaaaaccttgtcgtggatgtcgttctgtaaccccaccagcggtccggtaatccacccgacccagctcatcgccacggtccagtccaacaaccggcacaacagggcaatgaccatcaggtacgtgttccaacacatgccaataatggaggcccacatagccttcagcggggccgtaacgccaccatcgtccatcgacatctggtactgaaacaagtgaataccgttggagtcagtcacattgaaaccgtcacccatccagcccagccccgggcccgatgccatggcaggcacactgctcagcgccaccaccagaaccagcgtggtgacgatgatacggaaccgccgctccccggccccggggcggcgtggatgacggctcacgctgtctcctggtcgtgctcgggcgggttggagctggcggcttcgcggtggggagcgtaggcaggtctcagtagtcgaatttcaccgacgttgccgtgttggtcggcgtacaggccacaaccggggcctccggggttgagggcaatcttgaccaggtcagcgaactcttcaggggacgttttagggtccacgcccaggaactcgacacctttctgggcgaggttgatgttgtcgcacagcaacacgatgcgatgctgaatgaggttgcggacggtctcgttggggtaatcggcctcggggtcgtgggagccggtgataagccaggcattggctcggcgggattcgcgcacgtactcgtcaatggcgtgggaggcttccggcgaggacgacatgtgatgaaactcgtcaacaatgaaagcggcgtcgcgggcccggtcgctgaagcacaccaggcgagccagacgggcaatgagcgcgtagagggctcggccaaacaccttgtgcgggggcagctgccgaaacagatgttctgacagcatctcctcggcgttaggaagagcgatgccacaagtgccaatgatgaggatgtcggcactcaggtcggcgggaggaaggtccgggtcaaagatggccgaagctagggaggccgagttctcgatgtcagcgaacacggcaatcctgtcagcgatcgcggtggcctcgggaaggtcgcactcctcggccaggtggcgggccaaacgcccacacgaggtgatctggtggtcacgcatgtaggccggtttgaggaccttggccagcgtggtcccggccacaccgatggtctccaagttaagcaaggtcagcaagaacgactgggcgacctgcccggccatctccgggggaaggatgcgcagcgggtccagcgacagcttggggtgggccgtgtcgacgatctggcgtctaaccccgtcgatagagttgacaaaggttacccactcccgctcatcggagttgtcggtggcaataatgcgcccgccccgggccgcgatggctgcgcacagccgcttctcggccatcgtcttgcccgcgcccatcttgccgatgaacgccaccgtgttgcctttctgatcctgagtgtcggcatgcaaatcgaggtaggccagcgactgcaacggggagcctgtgaccacagccaacgggatgccggtggtacggcccaaccggtactcaaccaccgggatagatgcggcgaacgcggaggcgtgagtcagctgacggtaggcgttaagcgaggaggagaaccggccaccgggccgggcagcccacagcaagtcctcctgacggcccacgggacgcacccacgtgaagtcaccgaacaccggatcattgacgaacgctcctgccagctcctcggtggtctcaaagtcaggagacgagacagtgacggtgataagagcctggatctcgacctcacgctcatcggcggccagctcggcgttgtagtcgacgagcacctgagcggaatgctcgatagacatgagggtcgaagcctgggtcatctcaccgccctcgacgttgtcgagctgatcgaccgtttgacggatagcccgctgatttttctgcatcgcagcgtgacgggtccgggccactccccggatcgccacgtcgaccggcacgccagtgtcgtcgatacggcccaaaaactcgtaggcaggccacgtcatcgtgcggggcaccttacccagcacgatatgggactggtagacggtctcgccggtgtcggcaccgattttgaggacgcgacgattccacgcctgagccgtccgggacatgtgggagactcgcttgtcatcctcgctggccagcaggtcggaggtcgcggcctcatcgatgaccaactcccccagcgcggcacgtccaacctcatccatgagggcgattccctcgccaggggcatcatcacgcaaccgggtcgggtggcctgacaggtgctgccgaagccagatctgttcatcaacggtgaccgggcggggttggaacgctgccggcagtttcgcaccgaattccttagcctgacggagggcccactcccgtgcgacacggccaggagcggtggtcatgagtccggcggcttcggtgattttgttgagggcggcggtccaggcggtgtgggtgcgtattttctggtcttggttgagtttgatcgataggaaccacacgcgccggcctagggattcggtttcaggctggtcgagggtggcgtcgatttcgtcggcccacacggggtgttcgctcaggtcaaggccggcggccatggcgtcgacgatttctgtggggtcggtccaggtgagggctccgttgaggcagaactcgtggcgggcgaggtggcggaataggtcgcggtgagctgcggcgacggtgagggaggcgttctcggtgacgggtcgctggaggggagtgagtcgccaggtggcccagatgtcgccggtggaggtccagacgaggttgtcgaagaggaaccgttcggggatggacatcatgactccttttcggcggcggcgaggaaggcttccaggccgctgcggcgtacagcgttcccggtagggtgcaggggttttctgggggtgggttcagatttcgaatgtgggaggggtttgtggatggtatcggtgtcctcggcgagggcttggtcgagcaggcaggtggccggggtgtcggtagtctcgtccagctcgtcgatcatctcgtcgaggaggttgggggtggtggatgcggcccacacaggtgggatagccggtgcgggtcgaggcggtgtggggaggcggagtttggtttggccccagaggggtgtgtgggtcatgccggcgggagtggtggcggcgtgagtggtcacacgccaccagcccgccagccatgccagaggtgaccaggtccagtcgatgcgaccaacaacgaactgggcgagccatccggcagccagcgcgaaaatgaaaccgcggatggtcatgcccccgtcgataattttgaagcccatcatcgcggcaggaactacgccgccgacagcgagcacctgatagatcgtgtagggcccgccaggaatccttcgacctgaggaatccttaccgataatgcggggctgctggcgggcctcggtgtgccactgaatatccacgatcagctcttgcccaatccttgcatcatctgtccgaagaattggatcgcgttaccttcgataagccagtgcgccataccacacacaaacagcatggagacgatcttggccaggctcataccgtgtttgaagatgttgaacgcggcaatgcccacgactacgaccatggcgacggctcgcaccgcggactgaccttcacctgccttgatcgtcgtccattcgaagaggttctgcgattccagtggcagcaggaggaattgatcgagcatgagaggttttcctttcaggaagccgaccgggatggtcccggtactgacgggctggacggcacgggtgtgccggccaggggcagaaggcgtgacggctggtcgagggaggcaacctcccagcggcctgcacggctgacaagagtcaggccgtactggctggtccgggtagtggattcgtcgccggtgggctggcatgtcacggtcaccgtgacggtaatcttctgccggtctgagggggtggggacctcgtcaggtcccaccacatgagtggttttcactgatacgcatggggctgggtcaaccgcggtgaaagcggtccctgggctgctccatctcgacaggtcggtattcccggtcagcatggcggttaggaagcctgaagaggcttgggcggccgggtcggcggtgcgaagctccgaggtgtctagggtgggggctgaggccggtgcaggcatggggatctgtccaggtagacgcaaggcgatggccttgccgttggaatcgacgtggaccgggactgaccaggcctgtccgctcccggattggccgcccatggtgaccacggtgacctgccacaggctcggatcagacggggagacggtagcgtcataggcggtgacggtggtgggcgctggaccaggtttgcggggcatgcgcgcatcggtgatcttggccgccaccaggtgttccagattgtccaagtgcccggagtcagaggtcagcagaagagtagtcacctcgaccgcggtggctgaggcgatctgagctgtgcggcggtcgtgatgggtggtgtcagtgctgacagctgtggtgggagcggatgccggggccgccgaacggaccagggcaacggggccgcatgcgactccgcacagcacgagggcaaggaagcctttggtggccatcgatccggtgtggggccagggacccacgttttcctgtgcctgttttttcttggccgaccaacggcgggacttagggttagcggatgcaccttctggggtgcatgctcgtctcaatcgcatcggtcacctccttcactggatgaagggaccaaggaggtgaccgatgtgcggtcgaacccgaaaaagttcaaacttttttctgggtctgcctcaagtacgacagaaggcctgcatcatcacggcgttgtggtagcagatcttgcgtcagcgcaaatgtatgggcctcgtaggagtagctcttaggtgggtcccggtggttgcggccagggcgagggtgtcgggtatgtgtagcgctagtcccgggttcgtggtgtgagggcttttgggtgctgacatgcactacccattgctagacgctgtgctgtggcatggctggacgtctagcagacgggttgacatcacctttaggctggcagcgcccgaggccgcaggccagaggaagcggacagcctaacgattgacgtccccctctcctttccccaacctcctggagtcgatgacccggagatagatcgatgtctatgcatctgtgcatcgatatacctatgtatctgtctgtggtttttagaggccactcccgtcgccccgggccgctcagcgataccgcaaggctgtgtgggatcagctgtgccgctctcccgacatggcagacagcaccctgcggactgactgacactgtggcgccgcggaggtctcccgcggcgtccgctggggcgagtgcatgcctgtcagctcatcttttatcgtcatgtttccccttgtcagagcggtctttgcaaagtgacaacgtcaggggtcttgacgacaacatcctcgacaacatcgtggcggtggtctgtgtctcgtcagttcaacgcaccggggaaagaggcaccgctgatgttcaccaccacaaacaccctcaacgatgagtgggaccagattcgcgccactgagatcgattggcatgactgccctgaactgatgcactgcatcgacgttgatgatgtgttggccgtcattcctgccgcccccgacgccatcttgggctacctcattgcccgggctcagggcggtgacgagttggccacccgcactatcatccaagcgttcacaggcaagcttatcttgatggccacggccaccaaggtgcgccgtactaatgacggcttcaatgatctgttggcgggtctgtgggagacgatcatcacgtacccgttggatcgtcgccctgacaagatcgctgcgaacctcatcctcgacacgttgcaccgggttacccggttctggcgtgctgattcccccgatgaggaagaggctcacggtctggtgcccttccctgacactctcatcgccccagagcccgatgaggacgtcacagctagccaggccatcgccttggcggtggaccgcaactggattaccgaggacctagcccgcctcatgagccatatttactgtgacggtatgactggagctgatgcgggtcgtctgcatggctgcgctccagctacggtgcgatctcgatgccgtgatggtcgggccgtgttgcagcgcaacgccgagacgatcctggccgtctgctgatccctctcttgctcatgcctgccgccaccctacccctacctgctagaaacatagccatgtctccagcaacgcatctagcgtatcttctagcaattgatctagctatgtatatagctgatgatctagctaccatatagctgtgtctccagcccaaaggacagcccaatggcatgcttgccacaggaaggtgcgtcagcctcccgaaatactggaaggagctttaccgtgcaggacatgacctcgaccagaccgattgaccgatccccgttcgaccgcactattgcggtgtggaaccacaaaggcggcacgttcaagacgtccgtcgtggcgaacctgggatacctgttcgccgccggtggcaacaaggtgctgctggtcgacatggacccccaggccaatctcgacattgacttcggtatacccgcgggagaacgtgaacggggcatgggattagccgaggcgctacgtgaggggacggcccttcccccaccgcagcatctcagcgaaaaccttcacctggtcagtggcggcgctgctctcaacgagttcaccgaccccgcatccttagcggccatcctcgaccgagtcaccaccgcacgctacgacctgctagctcaggcccttgccccgctggcctgggactatgacctcatcttcatcgactccgggccggcacaaactctgctgtcccagaccatccttggagtagcccgctggctggtagtgcccacccgcaccgataacgcctcaatcactggcctcgtcgacgttcaagacgccatcgacggggttgcctcctgcaaccctgaccttcaactactcggcgttgtcctagccggcgtgggggcccgggccacccggatcgccgcagataaacgccacgccatcgacacagtgctgggggcaggaaccgttttcgatgcggtcatccactactccgagaaggtgtccgtgctcgcacgccagcagggcaagaccgtcgccgagctagccaacgagtaccacaacacccagcccgcctacacctacctagctaaaggccagaacatccccaacgtcgccaaggcagccgtcagcatcgaaactgattatctgaggctggccaccgagatcagcgaccgcatgttcaccagcgacgagcaggagcctgatcatgactgacgatccgactccatccgagcagaacaaccccaccagcgacgacatgcgcttggccgaagaatgggccaacagcggccgcacagtgggagccctgccgcgccgtcaacggcctcagcgacccacaccccgcaccaccagccaaccccctgtctcgtcccctgacacaccggctccgaaaaaaccccagaagacccccaccagccagcctggccgtcaacggatcaacgtcaccgtctacgttgtgcccgaactccatgagcggctgcgctcccgatcggcggcgacgggggtgacggtctcggatctggtggtgcatgcgttagcgttcgtcgccgatcatgcgggggaggcgatcgccgatgatctgcgcgtcgagacgggccccggcatgggggccggactgttcgatgtgaccccatcgcggccagtaggggtcgccaaaacccagctgggggtgcgaatgacccgccacaacaaggatggtttggaccagctgacccggacgagtggagcccgtgaccgcagccatcttgtgtctgtcgccgtgcgcgactatctcgactccaaccctgtaaagaaaggccgacatgtccgctgatgaaactcctgccgcccggggtgggcgacgctttgatacgaccgtcaagcccaggcgccgtcccatgcttatcgccgccggtatcgccatcgtgatagtcggcgcgctcctcatcactcagttgattcgctccgcccaaaccgagcatcgcgtgctggaagtccacgccgatgtggctcgcggcgaggtcatccgtgacaccgatctggtatcggtgactgtcggccaggtcgacaacgtatcaacggttcccgcagaccagctcgactcactggtcggcaaacgcgccacggcagatcttcgagccggatcactcttgcctgctggggctatcggcccggccgatgtcgttccagctccgggcaagtcgctggtcgggctgaagctagccgccggacagatccctatcggagaccttgctgtcgggacgaagctgcgcctgatccagacgtcggcacccagcggctcatccaccaccactgatagcagcaccaataccgatggccagtcgtgggaggcaacaatggcgaccggcaccaaaaagaccgagcaggtcaccttgatcaacgccgaagtgaactcgcgtgatgccgcccggatcgcccaactgacgtcacagggccgtatcgccgtagtgaaggatccgatccgatgagcaccattgttttgaccagcgtctcgggagccccaggggtcaccacgacagcgatcgggctgggcagggtctggccacaatcgagcctggtcgtcgaggatgacacccaccacgccatgctggcgggctacctgcgagcctcccagcacgccgaaccgaacctggccgcagtggcgaacctgacgtcgactccaaccaacgcccaaacggtgtgggaatctatcgccagacccctacccaccgatgacccagtcggcgggctgcgacgcaaaggcatcctcggcccgcccacgccgtggtctcgcgcaggcatcgacccccgatggggattcatgctggccctgtggcggcaactggaggaggctggcatcgacaccatcatcgatttgggtcgcctagccacaccactgacctcaacgccacacctgatcgccgcacccatcgtcgaggacgccgacatgatcttggtgatgatcgaggcgacactacgcgacatcgccggcgcccgcacgatggtggagggactcgctgagcagatgaacttggccggcgcctaccgacgtctcggactgcttgtccaccgtggcggccaggcccgcggcgtcgccgagttcaatgacaaggagatcacctcggcgttacgactcccggtcatcggggccattacccacgacccggccggagccgcccaactctccgacggggtcgggcagcggttcgacaagtcacgtctggcccactcactatcaaaggtggcggccagcctcgtcgatgccataaacaagcgccacgctgatgacgaggaggatctgtgatggccagttttgctgataatccgttcgacaagctgcgctcccaggatgcggcaagagcttcggtagagcaggagcctgatgccggattagcgtcggagttgttttcgacgtcgtcggggtgggccagctctcagcaggtgtcccaagctcaaccggtgatgacccgttcggagaacgtggattggccggttgtcgcggagctagccagtacggccactgatgaggttgaggctgagatcagcaggtggagttccactcatgatggggtggcgacgctagacattcgccaggccatcgcggagcctgctattgcctcggcggtgtctacgtatgctgaccgacgccagatcgatgtaggggagacctggcctgatctggtacgccagcgataccgcaaggctgtgtgggatcagctgttcgggatggggcggttgcagccgctgttcgaaatcagcgacgccgaaaacatcatcgtggtgggtaaccatgaggtggttgtcgaccacaacgatggttcccggtcaacgctgccgccggtggccgactcggatgccgagctggaatcccagatcgcccggatggcgaggaatgcgaccccgcggcgagccttcgacgccgatcacaccgatgtgacgatcatgcaccaacagaagttccgtatccacgcgatctcttcggaggtgtcgttgcaaccgtcggtggtcatccgccaacatttgctcacccaaatcagtctgggggacctgtcccagcggggaatgatgccggtggaagtggcccggttcctcgatgaggcggtacaagctggcaagtccatcgtggtcgccggcgagcagggggcaggcaagacgacgtttttacgagcgttgatccacgccattccgatgcgggagcggttcgccacgttggagaccgatcaggagttgttcgctcatctgatgcctggccgggaaaacacgctggtgctgttcgcccgtgatggtaacggcgaggtggatccggcgactggcacccagcacggcgctatcgagatcgcccagctgattcctcctagcctgcgccaggcgttaactagggtcattgtcggtgaggtgcgcggcaatgaggcttcggccatgttccaggctatgcagtcggggactggcactatgagcagtatccactccccgcgagcctctgaggtgccgtcccggctagcccaaatgatttcgatgggcccggtctacgatctggatcaggccatgctgcagatcggtcattcgatcgactacatcgtctttgttcgtaagcgtgacctgcctgatgggagccggctgcgatttgttgagcagatccgttcagtctcgcctggtgattcgacaactcccagtcttggcgaggtgtacacggctgactcgtggacaggccagccgcttacgccactcatgcctggttcggccgccgacgagctgtctcacttcgcccgagacctggattactgcgaggcccactgatgaacaccccagcgctgatagcagccctcatcgtgaccggcctgggactgatcatggccatcaacggcctgatcccggccacacccaaacccggcaccacgctgacgctgtcacagcggtgggcccgggccacccaccgcccagccggggcagccgggcgccgacgcgacctgcgctgggcgctggccggtctcgtcggcatcgtgctgttcgtcctcacaggttgggtcgctgccctggccctgggccccatcaccgtgctgctagcacccaccctgctgggggcggccccaccgaccgatattccgctgatggaggcgttggatcggtgggtgcgtcaggtcgctgcggtgctgccacaggggcgagacatcatcacagcggtgcggatctcacggccgcgggccccgaagctgatcgccgggtcggtggatcaactggtgtcccggttggatggccgtatggagccgagggaggcgttccagcggatggccgacgagctggactcggctgaggctgacgcggtgctggcctcactagcgttggcggccactcatccgcggggagcctcgacaacgttgaaggctattgctggcaacatccaacagcggttgaaagtgctgcggcaggtggaggctgagcggtctaagccgcgtaactcggtgcgccagatcacactggtcacgatcgccatgttcggggggctgctcgtgatcggacggtcgtttctggccccgctggcgacccctcccggtcaggtgctggtggccgtggcggtggtcatgtatgtcatcgcactagtgcagatgtatcggatggcgcggccccgtcgacgcacccggatcatggtcaggaggacccgatgaccattactgctttgtccctgctggccggggccatcgtcactgtcggactgctggtcatcgtggcagcgttccgcccagccccaggccctgacctggttgccgctctggaggtggtgtcgggtcgcacctcaagcgtcgccgagaacgtcgaccagacccggatcgggcggataggtcgcagcgtgacccgcacattccatgtgtcggtgtccccggccatgcgggccgcactgcgactccaaggcacgacccccgaagcgttctacggtcgacgcctgatctgcgcactgatcggggcgatcctgccgtggctgctcaacgcggtagccatcgcggtaggggcgaattccccgaacctactcatcccttcggcgctgtgtgtggcgttagctggcgctggatggatgctgccggcagcacggttgaaggctgcggccgggcccaccaacgatgactcgttcgaagcgctgctggtattcatcgatttggtcgtgctggaacggctcgccaacgaaacctccgtcgacgcgctcaccaatgcggcaaacatgtcggactcgccgctattcgtccagatccgtcaagtcctcaaccgtgcctccctggaaaacgtcgacccgtggaacgggctagaccggctagccgaggacatcaaactgcccgaactcaccgatgtggtctccatcgcccgcctccaaaacgaaggcgcctccctcgtcgacagtttccgggcccgagtcgccgagttgcgcgacgcctacctgctgcgcctgcaacaagaatccaccgccatcacccagcggcttggtttgtggacgatcctgcaagccggctcggtcatgctcatcttgctgggggcggccgccctcacactcatcacagccggataaaccgacatcgtgtcgagcccccatatgggccgcgaacctttcataatgatgcctgtaagcaccacaatattgatcacaacctaacaatgaaggagaaatcatgatgaccgatctcgacctggctaaaaaacagatcacctggctggcggcgcacctgcgttcccggatcgttgacgagcgtggcggtggtagctctaccgtggagacactgatttggattggtgtcatcgtggcgctggtgattggtgtgggcgtcggggtgacggcctatatcaggtcgaagatgcctcactgacgacgatgcgtagcaggttcacaactgatcagcgtggcggtggtagcgcgtcggtggggatgctcctgctgatgcctgcgatcatgctgctggcattcggtgggatcgaggtcgggatgtggtgtcacgcccatcagtcgaccatcgcggcagcccaaagcgccgcggaggctcagcgtgtcgtccatccggtcccggggtcggcacaggaggcagcctcgcagatcactagtcatggcggggtgcgtgatacccggatatcggtcagtgatgacggggccactgtcacggtgaccgtctcaggtcgggccccatcgatgctggggctgcatcttccggctgtgtcgtcgacagcgtcgatgcccaaggagcgcctgtcgtgaggcgaagtgagcgcggtggagcaagtctaagcgtcgaggtgctcatgtgggcgccgatcgcgctggtgatcatcgggtttgttgtgggtatcggccggatgtcgatggcccaggacgcggtgaatggcgcggcgggtgctgcggcccgtgcggcgtcgttggagcgtgatggacagtcggctcagtctgcggcgcagcaggcggcgtcggcgaacctgtcgtccggtgggctggcatgtgcgccgaatgtgagcgtggacacgtcagtgtttgcccgtcctgccgggcaggcgggcacggttcacgccacggtcacgtgtgtcacctcgctgggtcttgggttcgggtcccggacggtgcacgcaacggggtctgccccggtagacacctatcgggaaaggagaggctgagatggcccgtgatgagcgtggtggcggctcggtgtcggtgtggatgctgctcatggtgccggtgattctggtcatggccggcctggtttttgacgggtcccgtcagatatcggcaacccaggcggcccaggacgcggcggttgcggcatcccgcgccggaactgatgcggcagcgacaccgcagcttgctggccacgacggggcggccgtagcagtccaagcggcccgccaggcactatctgctgccggggtggacgggtcggtgcaggaggacgggtcgaccatcacggtgaccacgtctcaaagtcggccgacagtgttcctgtcagcgatcggaatcagccaggtaagggggcatgggcaggcccatgctcagcttgtgggaccgggagaacgcccatgacagtgatacgtcgtatcggtgccctggtggcactgctggtggtgatagccggcttaccggccgggctcgtggccgcaggcgccccgctagtaccggcgggcctgtcatgggcccatgtgcggcatctgttggttaccccagacatgaccgggtcggtgctggtgtggctggtcagcctcatcggctggatcgggtgggcatggttcgccctggccgtcgcagccgaagcggtgacgatgctctcagggcagcggctgcactggcacatgcccggccctcgcctagtgcgccgagtggcagccggtcttctcattgccgcgttcgcggccgcaccggcagccacaagcacggctcacgccgccgaggccacccatgtggcggtcgccgcccaggctggaccggcacacgcggcccccgcccaggacagccccgccaccacctctcaggccccggacgcctccaccactccgaaaatctggaagacctacacggtgcgggccaacgactacctgtggaagatcgccgagcactactacggtgacggcgcccaattccgtcgtatcgccgaagcctccggtatcgacccgcactcagagctgaaagtcggccagaaactgatcctgccggttcctaagaacacggccgcagttcattcggttaaagcgggggagtatctgtgggagatcgccgagcactactacggtgacggcgcccagtaccataaaatcgctgaagcttccggtatcgatgcccattccgatctagccgtgggccaaaaactcgtcatccccgggcccctccgccacgacgccacgccgccacaccactcggcgtcgacccacgcgaaggccgccaccccagcccacacgcccacgcgacggcctgcgcctgcccacaaagccacgcccgccccgacgccggccaccccaactactccgacccacacggtgaccccagctccggcctctgccggccactcgaccagcgacgagcacccactccatacggataccgccgcagcggacaaggccagcaacgaggacgccctgtccccaatccaggtgggtttgaccgccagcgtcggactggtgctggtcgccggactgatcaccaccctcaaccgccgctaccggacccggttcacccgccagccccgcggcaaggccatgaccctgcccagcccggacgcccaaactgccgagatagcgctgcgcagcaccggggcgactgacactctgacgatcacctgcctcgaccaggcgctccgcgcgatcggcgcatggtgccaccactgcgggcacccgctgccacccctgctggccgcccgcgtcgatgacgaccggatcgacctgctgctatcccaggcggcccccgaccatcccgaggcggtggagctggccgccgacggatcggtgtggaccctcaccgccgaccggatcgacgacctgctagcccacaccgatgacaaccaagcggctccgtggccgtctctggtcacactgggacgcgacgacgacggcgcccacatcctcatcgacttggaagccgcaggaaccttgcacctgatcgccgatgacgaccaggtcgacgcggccctcgccgcgatcgccgtggaactggccacctgcgactggtccgacgaagtcaacgtcaccctcgtcggccaggtgtgcccgggcctagaagacgcactagagtctccgaccctgacccgcgccaccgacgtggacaccctcctcaccaccctagaagctcgcgccgacgaccagcgacacatcctcaccgaaggaaaccccctcgccgctcaccgagccgaccccgccatctccgacgggttcgacgccgaagtgatcctcctcgacaccgaactcaccgaagaccaccgcaaccgcctcgccagcctcgtcgaggctcttccccgcgtgtcagtcgccgcggtaacaaccagccccaccagctcagacgaatggtccctcaccctgacaggtgacccactagccgccgacctggctcccctcggctggcacatccacccccaaaccctctcccccgacctgtacaaccgcatggttgaactactcgccaactccgccgccgcagactacgaacccgccagctggtggaaccacgacgccgacgacgagcccaccaccgaccccaccaacgaggaagaatctaccccgagcaggcgagcccgcccgaatatccgcctgaccaccctgaccggcggcatcgacctatccagcgtcgacatcgacgacatcatcgacgaagccaaccaggccctcgacaacaccgaccagaccaccaaccaggttcgcgtcgacaccaaccaacccggcaccgacacccccttccccatcgacgacatcgacccgctgagctccgaccatccggtcctatccatcatcggccaccccgacatcacaggtgccactggaaccgttgggcgctccccgtggcgctgccaacagttggctctctacatcgctgagcatccgggagcatcgggggcgactatcgccgatgatttggggctatcagcgtcgacggtgcgctcgattgctacacacctgcgacactggttgggagccgacgatgccggggtggcttacatgccggcggcgacgcgcggctaccggctcgatgagcggatcgtcacagatgtggacctgatcgacgctgctgtggccggggcaggcattaacaccgctgagacggccacactggtggccattttgaagctgggccgcggacgggtcttcgctggggttcctgactcggaacttcgccagttcagggcgtcgatgtaccacgtggaggcccgcatcgtcgatgctgccctccaagtgacagaccgggccctggaagccggggacctggggctggcccggtgggcgttgacccaagggctactggtgtctcccgatcatgaggacctggtcaccggttgtctgcgcaccgagtaccaggccggcaacatggacaaggtttccgagctggtcgatcacctgtcggctaccgcacgacgcctgggcgtcgatttgagcgccgacaccacccggatcatcgactccgttattacccatacacgcaggagagcatcatgatctcccgttgcactcatctccgtcaggaaggttcctatgcaccattatcgtcttggtatcggcactgccctcatcgcggtagcagccgtggccggctgtcgctcaacagactcgacacccacaccacctccatcccgtgtctccgccacgacatcagcgagctctaccctcagcccgaccccgtcagccggagcgatcagtgccgccgacgccgaaaacatctaccgcaccgtccaagctaacaagatcgcactgtacaaaaagggtggcctggcacccggggaacccgcacccgcgacactgtcgaactacgccaccggccaggctctcaccgactacatgacctacatgcaccaaatctcggggcagggcatcaaaatcacatcggggaactcctcggttaccgcggtgcgggagaaaaagggtgataccacctaccccgaagccgctatcgccttggaatcgtgcgaagacgacagttcgattcgtaccgtggaccgccacggaaaggctgatcatggacgcattttccatgtcgacagttggtatgcccgcgataagaagggcaccgtcaagatgatcgcattcaactcaacggaggtccccacatgcgacgtcaagtaatcaccgcggccgtactgggcctggccctggccaccacctccctgcccgccctcgcaggcggcggcgacttgaacggcagtgtggacacggatggccctggttacgatgtgcgtactgaggtggattaccatcacaccaccggtggtgcgggtgggggtgccacgacagggggccatcatgggggcaaaacccacggtgatggtgaaggtgaggctattgatgggcgttctcgcgccgatgccgaagccgaactagacgaagccgaccgtaaccaggacttgacttgtgatgtcttgctcccaccggcgccgaataccccagccggccaggaatgggcgaaagaatgcaatcccccagcgaaaaaggggcagaaggccaccccgaagcccgatccggtgttagtgggccgtcacgcggccttgcagctcacccttcccggcgcggcccctcgtatcgatccgtcccccgaccttaaccggtggcactcggcagcagtgggccaggctttgtggttgtcggttgatgaccccaccgccactacgcagaaatcgatcacgtttatgggccaggttgtctcgttgagcgccaaacgtaacggtttgtcgtttgatatgggtgatggtcatgtcgtgcactgtgatgccacgacgacatggacggagtcggtggaaccggggaccccctcacccacgtgcggttacacctaccaacaggcagccccggccgggggctataaggtcaccgcaatcacgtcgtgggatgtgacctggtcggtactaggacacacgggcacagtccacatccagaaggccggtgggcagatgcttccggtcggcgagttggagtctgttgttacacggcgatgactcctgatagtccgacgctgtatgaggtgttggaggtctgccctgatgccactgatgaccagatcaagacggcgtggcgtcgtgccgcgaaagtgactcaccctgatgccggtggcactagtgaggcgttcgcggccgcccggcacgcctgggaggtgttgtctgatcctgcccggcgcaccgcctacgatgccgacctggcgggggaggatgatcccgacgacgaagccgccgacgccttcgacgttgatccgttcacggcatggccctggtgcgccccgtacatcgacgccacccccaccctgcgccacacctgccccggcacgatcaaggccatcgtggtcgccatcgccgggatcatggccggaatcggctggcaggaagcgctggaggccgtggtgtcgccgccggggtttctgggggcgtgctggatagtctcagtgccggttgtcgtcgcagtgacatggctggcagcggtgacgggtctggcatttttcaccatggcggccatctggtgtggatggtcgttgataggtggtgcgttgctgtggggccagacgtcggtggtgtggctgattgctgcggggtggctggcatggctggtgtgtgcgtgggtgtggtggaaccgtcatctggcgtggagtagcgagctgatgcaggaaggcaatttgtacggccttcccgaggaagacccgttgtggggcgaggccgtggagctggtagcgggacttatcccctctgtgcgggcgatgtggtcgcacgatgggcagaccgtgactgtgtcggctggccggcgggtggcgacactggggatgccgatgcggggatggcgtggtatcgagatgcgcggctggaatccagtgggcgccgatacgtggtggatcgttgaccaggtgggtagttggctggtcgatcaggatgagccgatggtcgttgacgggagggtgctccatgaggcgtgggaacggtcgcagatggtccgttcaggccgctgagaaaaaatttaggtccgccctgcatatcggggcctcttcataccttcaaaagtgtgaagggaatacagactcttcgactggaattaaaatggtatatggcgtgtccggtccgcacccagctccacgatgcgccataggggagccataacttcaccaatcgtatacgatatgagtgtaggtgagcatctaccggtggccgacagtcagatacaagcatgggcggatgaagcagaagctgattatgacctcagcatgcttccgccgtctcgacgtggtcgcccaccggtggggaggggcccgggcactgtggtccctgtgcgcttcgacgcggacactctcaaggcgttgtcacaacgagcccctgacgaaggattgaccacgcgttctgacgcgatccgtgctgcggttaaccagtggctcggcctcggctcgtaaacattatcggcgcgacaaccttactgatgacgctgttggttacgccgtagagcacatcttgtactcgtgggcgctcgacgatgctgatgatcctcgttgctggatgatgattcggtgttgacccagctggcctcctcatggagctagttatcctcatctacgacgatggctatgaactcctgatccacgccatgaaagcccgccctcagtatctgagctacttcgctatctagtgttgttgggcgagttgaactcaacttttctccgacgcaagcgccaataaaaggctgatccatccgaataccaccaaacacggctgacgtgtggaacagattcagcaagacagggtgcggtgctcgggtgcgttggggagatgaggatattcaggcttctggcgggatgtggcttgatgacgtccaggatcaccggttcggttttgaaggtgccttgcattaatgtcgacagggtcgtacgactcgaggactggatcgaccagcccgttgcgtctgaagaacttcatccaccccggtggagctccggccgcgtactggtgcaacggatcattagcatgggtagcgtgagtatgccttcgatcgtggtcagtgctgtcatcatccaaggttctgacgggcggcttctcactgtccgtaaacgaggcaccgaggcattcatgctgccaggcggcaagccggagcccggcgaggactcgcgtcaggcagtagtccgggaagtgcacgaagagctcggcgtcgcattgtcttccgacgacctgcgtcgggtgggagtgttcaccacgcgagcagcgaatgaggccggccatcaggtggtggcgacgattttcacccacaccccggttgcggtgagtgagccagctgctgagatcgagcagattcgttggctcgattggagtgtcgacgccctgcctgatgacctggccccgctgctggtcgaggcagtcatcccgtggctgcggcgccgtatccggtcggtcgctgtattcacgggtgcgaaggatggaaccgaccctcattatcgtgtcgaagcaaccgccttgggccggggtctcgcacacgccgggatcaccctggtttatggcggcgggaaggtcgggatgatgggtgctgttgctgatgcggccctcgctgctggcggcgctgtgatcggagtgatgccgcagcacttggtggacggggagatcgcccatcctagtctgactcacctcgaggtagtgcggactatgcatgagcgcaagcagcggatgagtgacctagctgacgcgttcgtcgcgctacccggcggcggcggaacccttgacgagctattcgaagcatggacatggcagcagctcggtgtacacagcaaacccgtggccttgtacgactcgaccttctgggcaccgctgaccgcgctactcaaccacatgaccatcgaaggcttcatccgccctgaggaccgcgcctcgctcgtgatcgccgataccatacatcagctgatggccgatcttgagggatggaccccaccaccaccgaagtggcgctcgtgacatagaacaaatgattctgactatggctcattgacatctgcgcagcggctactagctccattgacttcaaatcgggccttggccgaggctcggttcaggtggcccggaatggatccccacaaattgaatgctcatgatcgaggtgatgaacgcccactctattgtcctacgcccggttgtatccagcgagcaattgaaggtgctgcgcctgttggtcgaccaggccgagccactcatcatcgacgggcgcatcttgtacgaggcatgggacaggctgcaaacagcccgtccggcccgctagaaaaaatttttagggcccgctccgcacatcccggtctgtacccacaccttcaagggtgtgaagggaataaaaacacacctaacaacaactttgtttcatgatttggcgcgtcggaccctttctgaccgatgtcgtgcgcaacaatggacccatgagttcgcctaccaagatgcgccggaaggggacacgcggcccgaaacctcgcagcgacgaggagctaacggctgtgatgttccgcgtcccagagtcagtggccgaacgtgtcagcgatatggcttgggagctgaggctctcccgatccgatcttgtgggctggtcggccctctatgcactcaactcgatgctcagacagcgcggagaggacacgattccggttccggagtatctggacaaggccgtgctcgctgcgttgtatcccgatgggttgcccttcgacgaggacaccgaggagccgggcgagaatgccgggcaggaggagcttgcgatgactggatgagcccgaacatggttgaaggccgccccgccaggcgaccttcaatcaatggtttcggttgtcagctgcagccacccttgccaggtgctgtggttcttctccagaggaggagggaccgccatgaagacccagaagacctagaagatccaaaagaaccggtttcggctgttgcttcggtcttcatggtagctgatagcccgcgtcgttggaagtgcgacgacgccgatcctcatcggtatcgcaccctgttccagggtcgagaatgtgaaggattaacaaccatgacaagtcatgagacgccctcccggagggcgtcatgaccgctttaattcaagctctgccgacagctgaactgtctgctggacctggtgctagcagtccagctagaccctctgctgagggcttcatcaagattcaccacgacctcattagtgcgggcgtgtcgggtaacgcgatggcgttgttcgtcgcgttacgtaaccagcccggctgtgatcagtggacccgtcactcgtacctgcggctagcccaatggtgcggctgggatgggctgtcggaggcggcgggctgtaagcgggtgcagcgggccgctgctgagctcgctagcggtggttggctggaatcgcgggtcggccatgatcgtcgcaccgctaagacgctggtgtggcatcggttgaccagccccgacaccgaccgctgggagcaattgccgcggattgtgtgggcgaggatctgccagatcgccggggagacgtcgggagagtgggtgaggcattggctggtgtggcggatgctggccggtcgtactggtgtggctcaggcccctacgtccatcgtggcccggttcctgggctgttcttcgcgccaggtctctcatatccgtggggctctcgttgatgccggtctgctcggctgtgacgaggtctcgggggcggcgagccgggtgtggttcccctcgatggccgaggagtgtgcagcggatcgtgaggtggtcgatggggccgtcgtcgatgctgaggtgggctctggtgaaggtgtcgaggagggcggggaacccctgtcgattttgtccacccacccctgtcgattttgtccacccacccctgtcgattttgtccgccaagtattagacaaaccattagacagtgaattagaccctgggtcgcgtcagcgtgtgaactcaccaacgcgcgcgcgcgcggcggccgagccgccgaagccaaagaaacccataccaccaacgcctgaaccagcagcccccgcttcagacagtcctgtgtcagcgcacgctgatgaggctgccgagttggcgtggcagttcgtggggtggtgtcctcagctggtaggggcaccgaagaaggtgcgtggccagctccgccagatggtcgctgccgagatccgccggaatccgggctggctggatgcgccagcgttggaggttgttgcccagcgggtacgtgctgaaggtgcgctgggggtccagcactgtgagattgtgcgagccgagctgcacggggtgatcgccgaccagaaggccgcccccgcccgccccgacgccctgcacgcgcgggagcccaagtggtgggacgacgtgtactacgaaggaaacacaaccgtgtggtacgactctgacgaaaccagtgacgacgacgaggcgtggaaccggtcgcaggtatgtcatgttgctgagcgtgacgacatggctggcgggattgctaccaacctgctggcctcccacgctgatgatccgatggcctggctgactcgccgtcaaaccatgctgatggctcgtttcccccacgcccagaacgaggtcatcgcgatgtgccacatcgtgcgcaccgccctggaggccgacatggccgccggaacccggtgggaggactgatgagggtctcccggcgcgccctcatggccgtggcccgtgccgacgctgccgcagcagaccatgccaccggccgatgggtggccacagccaacgccaccgtcgcccggctgaccggactgtgcgaacgcaccgtccaatacgcccgcgccaccctggtccacctgggcctgtgccgcgtcgtggccaccggccgctacctcaccgccgacgagcggcgcacggctgctcgcacccatggcggccgccagatgcgcgccgcctccacccgcgtcctcaccatgtcctgcgcaatcgtttgcgccctaccccgaaggggtcaccactacaggaaagttaagttcctagatggtcaccaacgcacgcgcaggcgcgtgcgaaggccagcaacaccagagaagaaacccctgtggctgcaaaaactcgcagccctcctcgaccagcacctgccctggctggtgagaaaccatcacatcggccgactgtgccacgccctcaccgccctgggcatcgacgaacactggcaacccgcagacctcgacgccctcctcgacgccatgaaccgcaggaaccgtcgcctcggcctcgacgtgccatgcgccgacgaccagcacaaccccttgggactgttcatccatcaggcccgagacaccctcacccacgacaacccccatgaacgccgcctagcccgtgacgctgaacgcgcccggctcatcgacgaccaactccgccgccgcgcagaaaccgccacctgcgcagcccgcctcgcagccgagcacgccgaccccgactaccagacccgccgtcgtgaacgcagggaaaccctgcgagccacactcagggccgcccagcagcatgtcaggacacactgatacccgctcatacgcacaccatgaaacacgacaagccacctgacagtatcagctgcaagacgcatgacaacatagaaggacatgatgaaatacacatagacacaaccccgcacagcagtttcgcaacaaatcatgatagtctcatggcagtatcgcttgatacacacatagcatcactcccacataggcagttatgctgatatactcctactaggttatccgtccaacatgctgagtgggttcctgtacagcatgaaaggagcatggcatgatatgggccgttctcaactgcaagggtggtgtcggcaagacgaccagtgccctcctgctggcggcagccgccgccaagcagggccacaccaccctggtggccgacgctgacccccagggcaccgcatcccagtggtcagccctggcaaccaaaaacgacgaacccctgcccttcccggtgcaagcggtcaacatcgccaccatggaggcactgcccaccaccaccgacgcccatgatctcatcctcgttgacacacccccctcggcaggcgatctgatgttccaggcatgccgcatcgccgacctcatcatcatccccaccgccacctccggacccgacatctcccgaacatgggtcaccatggacgccacacaaggcacaccacgcgcgatcctcctcacccaaaccgaacacaaccgtgtcgtctaccgccaagctcgcactgccctcgccgccgacgacaccgtcgttctcctggaccacgacatcccccgccgtgaatccatccgcacagcatggggcaccaaccccccagacgacgtcatcacctactacctgcccgtcctcaacgaactcatggaggccctgtcatgaccaccaagaaaaccgacccattcgcccgccagaaagcagcagaagaccgcgcccaccaactccaagacgaagcccaacgccacgcccaccccaaacgcgtcatcggccccaccgcacgattccagttcgtcctgccagccgacgtgctcaccggcctcaaacacctcgccctcacccgcggcaccaccgcccgccaactcaccctcgacgccctcgacaccgcctacggcctcgacaccctcgccaacagcgggaagaaaacccacccatgacccgtgggtccccctgccaccaccccctcgacggcaactgtgtgcgagccacaggcccgcacacaggcggcagcccagtgccgtccccgccaggaaaggaactgaacttttctggagtgctggctccctatcaccccttatggtgctatcagatccagtagcgccagcccgagaggaaacccatgagctacatcgtccgcaccggaaatctagccggcacccccgagctgcgcgaggggtagccgacacggcggaccgtgcccctgacagtaagcggcactactggagacatcaccatgaccgctcagatcctcgccccgtgcaaccagaaggctgccgtcatcgaaggagccctgccatgaaccaacctaccccccacaaggccgacgagtcacagacgagcaacaccacgaggaagtggcggcacaaggtgtcgttctaccaagacccggccgacaccgaccgagtccgcggagcgatcctccacaccatgacaaccgaaggcaaccggaacctgagccagttcgtcaacgatgccgtcatggccaaggtgaccgaactggaagcaaaatacaaccacggcgagccattccccgccgtgggagcccgaggactcccccagggcggcgcagccgccaacagataagagggcggggaccaccaatagcagtcgatttcggatccagatcgggtagacaggacccatgatgaatttcatatcctccctgctctcggccatcctgaccctctttgcgatggtagccgtggcgataggagtggtgaacattgtgccgggaatatgcgccatcatcggtgcacggaaatacggcgaccaggaccgtgtgcgggcaggacaacgaaagatccttcttggtgctatcgccttggtggtagcagtaggcattcacccgtgacccacggttaccggaagccccgccgcaatcgataccactgtcagtaccatcaggggcgataggggtcaagctctccttgtcacaatcccttccccggcagcccagtaaccgtcgcttacagccatacatggatatgcgcccattcgtcggcaccgacgccgtgcgggttggcgacgctgacccgtctgctcacaaacgacccttccagcccagcaccacccactacaccgacacgatccacgaagctgaaaccgaacctcccatccccgtccgaaacatcaacgaactcatcaaccccaccaaccatgcatgaacgcacgatcgcctaccggccagccttcctgcgcgacgtgaagcggctcaaaaacaagcactacaacatgaacacacactcaaatgggcggtaaggtcacgaagtcgacgtggctgcctcacggatggcttcggcgagctcttggggtcgactccacatgggccagtggccggttggcagatccatcgcggtgaagttggtcaggtgcgcgacggcgctgaacatcggattgcctgctgcggccagctcgaggacctggacgctgggaatggagcagcagatcaacgtggttagtacatcatggcgagcgctattggacagcgcgacccgtgcccgggccacttgcgcgggttcaggaaccgcccgtgcccggaaccggtcaaggtgctcgttgctgaggccctctaaactggcctgcttgccgagagtatcgaagtcaggaagtggcagctcagctgtttcctcaggtagatctggtgcgaaggcacctccatcgctcatgggaccggagtccacccagacgatccgatggaccaactctgggtgcctgtctacaactaggctcaccggcccgttcgcgccactgtgtcccaccaggaccgcatcgccgcccatctcgtccaggatggctgagatggcgtcagcttggtcgtcgagcgtgcgcgtagtgcgctgggtgtcctccggatcgaggccaggcagcgtcagccccacggctcgactgccagcagtgttcaataactcgactacctcgtcccaagcccaggctccgagccagtaaccaggaacgaggacgataggccgatgctggtcaggtcgcgatgttgaagtcatggagacatagttgcacagtgcgcggacaagggagtggcactatttctggcatgaatttagatctgggtgtccggtgaggcgatcagaacgcctccatgtactgtccgagtgtctacgatgcagcggacacagtcgagcagctggctcacaagtttccaggtgtccttctgcccctatgagggaagtcggctgctctcgcaacctttgagggctgctctggggtcggaaccagttacagatcgttcaagttccgggaactaccgccggtcacgctgattgattcccgggcgatctcgcttctgacgacagtggtcggtaaccgagaggcgtcctactctgaccccgctgctgcggtgagtaaatcacgggcgtcccggatccggccacccgtccaagtgccagccagcttgatcggctaggcatcgtcaaggagcgacgatgaggtgatgatgcgatgtgagcgcaccgcgaagtgaggtataaagaagccttcccgggcgcatgcgtcgcccaggaaggccaggttggcccctggacggctgaatggttgggcggatcaggctgtagcggagacgtgcagtacctcgtaggcgatggcgttggttgggctctggtctgcatcgtggctactgagttcgacgaggatgacggtccaggtggtgatgtcgacggcggtgacgcgggcgatggtggaatcagtggatgctgcaaggaagtcggcggttatgtcttcgatgcagtgggacggagcagtgctggtgggcaggggcacggtcttgacggtcaggcttcgggcagcagagtaatcggcggttccgttaacaagctggtggacggtccagtcctggatcgggtgccggccgaagtcgcgtacgatagccgagtaaccaagttcgccccagcagaactggcgcatcccctctatgtcgcgccagacgtagaagggcgcgtaggagttctggggtgcgcctttgaccttttcttggatgaggtaggccttgaactccagtccatggtagccgtccatgaggtgtccagtctggatgacgcggtcgcggatgatctgcatgtcatagtcggtgggcagggtgatctgatattgcatggcgtacatcagcggttctccttggtttcgtgggagtaggtcgtggggatgacgggttcctgccaatcgatggttgacaagtcgtcggcggcttgttggtaggtaaggtggatcattggctgtttgagtgcagcgccatgccagtgtctctggccggcgtcgatccagatggattcgcccttggtcaggtgctggggtgcttgtccttcaatatggaccagggcaacgccgcccgtgacgtagaggccctgtcccttggggtgtgtgcctcagcggcaaacgtgacggcgtgggcggcacgcccggcgtcttccgtggcacgatcggccggatccatggcggcgcgcagctgctgttctgcagccaggcgtccaggtcacggcgggcagcatcgacacccagggcagcctcgacggcttcagggctacgacgctggccgggctggttgaccgcagaccactggtgccgggcgtcgtccagatcatggccggcggcgtcgatgagggcggtggtggcttcggcgcagcatcgcctgatccactccgaacgtgacaggccagctgtctcggcggcactgtcaatgcgcgccaggagagatttcatgggcgctcatctgtagcctccagataggcgttgatgtagcgcagagcctgatccgtcatgtcgatggcggctgcctcggcagacgacacaacgggctgtggatgataagaccacccaacatagacggcgaacatcaatttctcgacagctttcatgaggtccccggcggcaaccgcatccgcctcatcatccgaggagaaccacttcaggtctgaacggctgtacatagcccctaggtcctgatgtgggtcgaggtccttggaatgatggaagttcctacacacccatcgccaaagacctcaacatggacaacgctaccttcaccactccctcatctgtgaagagccagtttatgcacggtgttgaaagaggcgtcggtctacgacgaatgcgggttaatggtcttgcggtgtggggcgctgggcgatggcatcgagaacgcgtgagtgggtggcgatccattccgcgtcggggttgatgttgcgggcgacggtgtcgatcgctgttacgtagtgggcaagcctgcgaatctcagcttgttggtcagggtgatcgctgatgagaggctcttgatgggaggcgcggttacggacgtggcggatgagctccacgttttcctcgaagtcgcgtcggctacgccccgggtagtgaggcatacctccgttacgtaagtcagtgagagctttccatacggttgcttccaggcgcggggtgagcagaaagcgccagttgtccagtgacagactcgccacgatctggatcaggggtcgcatcgagtcctcgcgcgcccgcagtcgcttctcggccctggcgacgttacgcgggaaaccaccgagccgatagctcggggattcccaccaacgccgtatgccagtatcggcgctcaggcgcacgtcaatgaagtttctcaggagtacctcgacatggctgatgtcttccaagaacgctttcgagatgcgggtgttccacacgtaccacgcatcgactggttcgatccggtagcggctgagcctggcgggtgagaaccactcctgcaacgtctcacgactcaccgtgggagcgtggtaggattgatgacgataggcctcgggaaggtcaatgccgcgaaatatcggtatacccccgaggtcattgttttgcccaggcccctcctcgcatacttgcggggcgtcattggctgccgtcatctcgtctcttcccggtacgtggctgtccatgttcacgggcaggtacggcaatgaggttcccgcacacaaacctctaccaagcatacgctggcaagccccgacgagacgacgcctccgcccgccacaccaacggtcaccgccacggccacggtgaccgtgaccgtggcaccgaaacccaagccaaagcccaaggccaagccaaaggtaaaacccaaaccgaagcccaaggcccattcatgatcgcagtgcccgatacaaggtggagcggcccacaccaagctgggccgccaccttcgttttcgggacaccctcggcaacgaggcggcgagcgcgggcaagctggccctcgctcaatgccggtttccggcctcgatagcggccctgcttcttcgccaccgcgatcccctcggcctgtcgttcatggatcaacgcccgctcgaactcggccaaggcacccagcagatgcaacatgagctggctcaccggatcagcggaccccggcccatagacctgcccttcaagggcaggcccgttatgctgtcagcagatctgccagttgtgggtgctggtgtcgtagcagacgccggtgtcggtgtcgtcggtgcggttggtggcccagccggtggtggagtcgtcgagggtgatgtggtggaggtcgggttgagtgttgagccagtgagtcccctcggcttggggtaggccatcgaggatggctagtaggtgggagatggtggctgtgcgggtgagcgtgaggatggttttggatgtgttggtggtgtcgatggtgaagccgtagttggcgagtgcagcggtcacatcggtgggctggtcggtgtagatgcggttggtgagtacggagcagttggggccttcgccgtagatgctgatctccacgctggtgccgtggtagtgggcttcgtaggtttcgtcgatcatccatgttgtggcccagtcggcgtcgacgagggtgtagggggttcgggtagtgggaagtccgatgtagggcttggtcaccatgttgacgtgtgcggtgtacttcatcgttgattcctttcccgatctctcgttctgcttataaatatatagcccgatagacggactgtcaagagtactagataaataatctaatacgcttgacttgaaggatagttgagagaataactcacatgtgagatgctatcagcggcgcagaatgccccctccgggccccttgctgcccctttgggtggccaaggctgtaaaccgcagcgatacaggcttacaggtgccccgaaggggcgcctatccacgcgctcacccgacgccgaaggcgtcggca

SEQ ID NO: 32 - DNA, 26620 bp, Propionibacterium acnes
ccttgtggacaccacgtcatccacatgacttgtgtcacatgattcccggaccatcatcaagcagatgctcacccaactgtaatgatttctgttctgaatctggacatgctctgacctgcattcaatgatcaattccgtgcgatattccacaacgcacggggaggtcgcagacaatgacaacagaaagcatccccacgcggctgctcgtgtggcacgagcagaccgatccgaccaagctcctcaggatcaccgacgcgatcaggaggggggatccccttccccccatcgaggccatggcgatcggccacagattcctcgtcctcgacggtgcgcaccgggcccaagcccaccagtactgccatcgatctgagatccgagcccgcctccacaacctccccctcagcgcggaaataccaggctggagccactccataccccgcgatgcagcagcgaaactggctcacctactcctccccgtggacgctctcggtcaggcggaaatcgtcctgcacggggtgcgccgtcaggtggggaccgcttcacaacgaccgcgcgacatctttctcgcctgccaccggatcgcgcgagttgcctacgcgcatggaatcagacctctcggcccggagttctccaacgctccgacgatcgacgccgccaccatgacctggcgcccgccgaacgtgggcacgttgtgggccatcgccagcagtctcggacccctgcccgcaactgtgacccggttcgccccgatcctccggcacgacgccatcggggattccgcgatgacacccgtcacctccgccgcgtgacgacccgcgccaattccgccccaccactggatgaggggcagccgcgtggacgatgctcctgttcaggcagggactccatacgagaccaataggaaaatcatgatcaaaaacacaagccctctgaccgtgaaaaatgtctcgaaaacattccgtggctccagcggagaagccatcaaggccgtgcaagacgtgtcattcaccgttgagcgtggtgaggttgtggcattcctcggcccgaacggcgccgggaagtccaccaccatcgacatggctctcggcctcacccgccccgacagcggccagatcgaggtcttcggtactgacccgctcagcgcggcccggtcgggacgctgcaccgcgatgacacagaccggcgggttgctgcccgacctcacgattgggcagaccatggagatcatctcctcgctctatcgtggctcccacatgaatgcctgcatggagcgagcaaggatcacgcatctggccgatcggcaggtgtcgatgtgctcgggaggcgagcgccaacgacttcgcttcgcactggctctgctgcccgatcctgacttcctcatcctcgacgagcccactgcggggatggatgtggaggcgcgccgggacttctgggcagagatccacgaggacacgcgtcgtggtcggacaattctgttcgcaacgcactacctcgacgaggtggacgagttcgccgatcgggtcatcctcatcaaggagggccgcgtcatcgccgacgacacctccgacgcgatccgcaccatgtcggggggttgcaccgttacggcgaccattcccgacttctccctggcacgactgaatctgccgggcacccaactcatcaagcagggcggcgcacgcgttgatctgcaccatcccgattccgatgccctcgcagcgcgagtcatccagctcggcggcaccgacctgcgcgtggtcccccgcagcctcgacgacgccttcctcgctctcacctcaaccaccaaggagtcctgacatgaccgcccaagcgcttcccgcagtcgccactcccaaggcccgccaccgatccgccatctcgctgaagtacttgtggtgcgagatgcgtcgccccttccggcgttcgacgatgctgttcaacctcgccctccccgcagttctgtacctggccctgttccgcaccgtccacaccgccgagctgccggacgggaacttcgcgatgtggatgatgatcggcatcgctgtctacggagcggccactgcgagcaccagctacgcagcctccatctccgtcgacgaggccaacgggtggacccgcaccatccgcctgacgccgttgtcgtcggtcgggtacgtgctggtgaaggtcctctgcgccatggccatcgccctggccccgaccctgctcatcggtctcatcgggctgttgaccggagctcacggcacgctgcgggtctgggtaatcggactgggggcggcttggctcagctcagcaatcttctccgccttcggcctggctctcggactgtccctgcgtcccgaggtcgtcatgcacgtccccggcctggtcatcaccggtctggcgttcctgggcaacgtcttcgtccccctcagcgggacgatgctcaccattggccgctggagccccgcctacggcatcaccgcgctggctcgttacccgctcaccaacggcatcgacatcgggggcggccacgactccctgacggctgccctcatcggcaccttctgctggttcgccggattcgtgttctgggcctcccgtcgatttaccaagagcacgggtcgtcagtgacagattcggccgatctccggaaggagcagtgttatgaccaagcccctcattgcagtggtcaccgcgggccaaggagcgcagaagcctcgcctgctcacgccatggctcaaggtccccggcgtcacggagaagcttgctgcatggtccgctcaggccgatgtggacctcgtcgagctcggtaccagggcgaatgcagaaaccttggcagcgaccgagaatgcgcagccactactggtctgtctcggagtcctcgtctcggatctcctggccgaccagaacattgtgctcgcaggacactccgtgggcgagctgacagcagcgtgtctcgccggggtagttgatcccgggacggccgtcactcttgcacgacggcgtggactggccatggcgcgggcctgcgctctccacccgaccaccatggcggccatcattggtgacaatccggatgacgtcctccggcggctctcggaactgggactcacggctgccaacatcaacggaggcggacagattgttgcggccggctccaccgacgcgatcgcggaactggtggcgacccctcccaacgggaccgcagtcaagccgttgcgagttgctggcgcctttcacaccaagtacatgacgcctgcgcaggacgctttcgcccaagctgctcaagacgtcaccttctccgacccgcagcacccgatcatctccaacctcgacgggcaggagatccggtccggcaatgacctgcgtgaacggctgattgcccaggtgaccgcgccagttcgatgggatctctgcatccagcagatcgcggatcgtcagccggaactcgccctatcggcccctccggggaaggtgcaggcgtcgctcttgtctcggcagatcccggacctcgcgacggtctgcatcaccacaccacgggaggcagcccaggctgcacagcggatcgaccagtccgtatccgtccttcagggggcatgatgctcatccccgagtacttcctcacagcctgttcggaccatgctgagcgcctggcgatcatcacccacaatgacgttgtgacgtgggccgaactggcgactcgcgtcgacggttttcggcgctggctgcgggaccatggcgtgcaccgccaggacagggtcgttctccagacgccaagcaccgtaggcacggtagccctcatgtgggcctgcctgctcgacggcgtgacgatggtcccggtgcaccaggacctcactgcctcccaggtgcagcaagtcatcgacgactgccgtccagctctggtgtgtggcagcccggacctcgtccaactcctcaactcccccggaatgaagacaagcacacctccaacgcggccggagtcaacgagtattctgccgtccttgtcccgggtcagccccgatgaccttgcgatgctcatctatacgtccggcacgacgggtctcccgaaggggatcatgtgtccccaccggcaggtcgccaccgccgcacggatcgtccatgactgtctcgggtaccgcacggacgacgtcattctctgtcgcctgccgttgtccttcgactacgggctctatcagattctgatgtctgccatctccggtagcgcggttgtcctgcgggacggaggcgcgcaggaccgcaacctggtgcgcgacatcgcccgtcacggcgtcactgtcgttccagtcgtgccgtccatggcgtcaatgctcatcaccctgcagcgtcgtgatcagttgccgaccatcgtcagactgttcacgaataccggggcgcgtctggcacccgagaccgcgaaccagttgctcgcaagcttccccggctcccgctatgcgtcgatgtatggcatgacggagtgcaagcgcatctccatccttccggtggaggagtacgagacgcatccggacagcgtgggaagagctctgcccagcactcacgtcgagatcgttgacgctcagggagttccggttccggcgggcgagcacggggagatcacggtgtccggcccgaccgtgatgaacggctactggcaggtgccgaacagtcccagtggacgattccgacccagcggccacggcctcactctgttcaccggtgatcgcggctggatggatgaggagggacgtctctacctcctcgggcgcgacgacgagatcgtcaagcatcacggcatccgaatcagcctgcaggagatcgagatagccgccgaagccgcgccgggcgtcgacgcagtcatcgctctcaagccggcctccgactcggcccccattgaaatcgcctactgcggcagcacgagtcccgagaacctggcccgccatctcgaaaccgtcctggaccgggcgcgacgaccccaattcatccaccaactccagcagatccccctgacccgtaacgggaaaccaaaccggtcagcagccgccgaggccatccgctcaagggcgtgacggcgaaggccaacacccacagacgaaaggaaaccaccatgacccaggccgagttcaaccagttcatcgagtccacctgctccgcgacgatcgtggatcccgaccgtcctttggtcgatcagggcatcgactccctcggaatgctcaccctcatggtcgctatcgaggacagcctcggcatcgaactggatcccgagtccctcgccgacggtaggggttccacgccctccggtcttctgtcccttgtcgagcagccgaaagcgacggtgtgacgacatgacgacgatggttccttgccgccgtgtggagatgccgcaactgttcgaccacatccccggaagcatctctctctcaggagggctgcccgatctgagcgtgctcccgagcaatcagatcgccgaactgacgtcccggatcatgcgtctcggctcaagaatcctcctgcaatactccaccccttcggtctcgtcctccttggtgccggccatcctggacctggcggaacgaacatgcatgtcaccggatccgcggaatctgatcccgaccgcgggttcccaactgggcctggccatggtgatcaatgcctttgacggcgatgagatcatctgtgactgcgccacctatcccggggcgctggccgccttcgcctctgccggcgtggaaacaacgggggtggccagtgacgaggaggggctcaacccagacgcgctcgctcacgccgtcgcagagggtcgggccaatggccgccgcatcgcagccgtctacaccacgcccaccttccagaatcccaccggctccgtacagtccgagaaccgccgtgcggccctgctcaaggtgtgtgctgacaatgacctcctcctcatcgaggacgatccgtacggcatgctgtccttcgacgggcagacgtggccagctctgaagtccatggacccacagcgcgtcatctacctgggcaccttctcgaaggtgttcgcaccgggcgtccgttccggctggatcgatccgcccgccaatcttgtcgagaaactccgcgctgtgtgcgagatcatgacactctcgccatcagccctcaaccaagcgatcatcggcgagtaccaccgtcgtcacggatgggacgaactgttggagggctatcgcgcctcctaccgcgaccgagcccgtctcctcatcggggctctcgaggctgaactggcaagaacgaattgcactggcacgtggacctggcgtgaaccacggggcggcttctacctgtggttggagaacgtcgccagcaccagcggtatcgacgttgcgcgtcgcgccgccgacaacggagtggccgtggtgcccgggaaacacttcgacgcagccggacacgattcgccgagcctgcgggtgtcgttcagcaattcacgcccggctgatctggtcgaaggagctcgtcgtctcgcccgtgcactggtgggagaggacgttcagaaatgactctcgcgacacgcaccgccaccgacaccctgcagcagaccttgccctggggcacccacgaacgtctcgtcttcgggcgggcgctcctgcgcagcaccggcttcccagccgaaggcttggccctgctcgactccgacgacatcctccccctcctcgactcctttcttgccggggacatcgacagaactcacttcgagaaggaatacaccagtcgcgaggagtccggcgcaagggcgctcatcaacgtcttgaaggacgatgcagtatcgcgcgccatcgcatggcagaaccccaccgcgtggaggtccttcgaatccctgtcgtccacgagcggaatcaatgcttcgactcggcgcaaggtacgccaactcgccctctactggcaacgttactgttccaaggctgagaccattggatacttcggcccgttcgcctgggccgaagtcgacccggaggcctctgcggtcgaattcatctcctccgaccatctgatcgaccgttcccacgtcgcaatggaggcgtgggcggtcattgagatcgggaaagccctggcatcacgggccgaccttcagtggtggatgccaccaatcctgtcccccgccgtcgacctcaacatggagagaggcaccgtgacggtggctggacaccagccacgacgggtccgggaggacgaggcacgagttctcttcctgaccgacggcacccgtcccgccgcccagatcgccaagagcctcgacatggagcccgagcggttgcgcaggatcctcgtggcccatgaacgtcgtcacaccgtgatctgggacgccaacatccctgtctcagtgcacgcgtgggacatcctgcacgaacgcattgcccagatcggagacgctgggctgcgagatgaggccactgctgttctcacgaggttcgacgagcttctggaggtcatccgcaacattcccgacgcccggtccctgacggaggcgacggaatccctgtcccgtcttttcgaaaccgtgacaggaacctcttcgaacagacgtgcgggccaggcatatgcagcccgcagcctgtgctacctggactgcacccgcgccggaaccgccaaggttgggacccggcttctcgaagccctcgacgcccccctcaacctcgtcctacaatccgctgactggttcgcggcgaccttggcaaaggaatacaccaccgaaatcacggacctcgcaaatcgaaagcagcgggcctcccaccagccactgaccatggctgatgtctggccgtccacgatgtcgctgttctggggggactcaccgtccccactgcagcgagccgtgaccgaactgtcacggcggtggagcagagtcctcgaggggctgcagccagtcgacggtcgcatcgacacgacatcgtccgctctctcgggcgccgtggacgagcagttccccgtgtgcaccccgattccagaactgtcagtgcacagcccggacctccaggtcatcacctcgagcactagcaacatcgcctccggacgagtcactgcagtcatgggtgagctacatgcctgtctgagcagtctcgacatgccgttgctcgagtggtcgctgccccatggttccattcgcgatcgcatcaacaccgcgctcaacctgcgacgtctggttcccttgttccccgagacatggaggcgcaacaccggccgcatggttccagcgacggtcggagtgggggatcgcgcaatcgggttcactcggacggccgatcaagaccgtgcgaacacatggtcgatgtcggcactgctgttcgagcagaccgaggacggactcatgatccgtgatcccgatggcaggctctggaccatcgcacaagcgtggagcgtgcccatctccatggtcgccgccgatgcgttcaagatcgggctgcccggctcaccagcccctcggctcaccattgacaatctcgtcgtgttccgtcgtacctggaggtttcccgctggctccatcgacatcatgcacggttcagccgccgagaaacacgctcggctgagggagtggcaggtcacgaatcaccttcctgaccacctcttcgtcaagttcccctccgaacccaagccgatctacttctccttcgagtcccccgccatggccacggtcttcacgcgatcactgcagcgcgacgcccgagagaatccagacagtctcgtgacgatgtccgaagcactgcccgagcctcaatcctcatggctgcacgacacccggagccaccactacgtccacgaattccggctgcaactgaccaaggagcgacatgacgaccacagttgagacacatcccgaaacacgtggcacaaccgcgacatccatctccaatctgatcggtcacacccctctcgtaagaatggaccatctgttcgacggcctccccttcgaggtgtacggcaagctcgagaagctcaatcctggcggaagcatcaaggatcgagcagcacaatccatgatcgaacgggcaattcgacggggtgagatcgtcccgggccgtacgaccgtcatcgagtccagttcgggaaatctcggcatcgccgtggcgatactgtgccaggagcacggcctgaatttcatctgcgtaaccgatgccaaggccacgccaacgaacattcgactcatcgaagcgttcggggccactgttgaggtgatcgaagaacctcatcccgagagtggcgaattcctccccatgaggctcaagagggtaagagaactgctgtcagagattccagatgcatggtggccgaatcagtacgggaaccccgacaatccggcggctcacgagcggactgtccgcgagatcatcgaggcaatcccgcgggttgacacgattgtctgcgcgaccggctcgtgcggaacccttcgcggctgccacgaagcattgcgaaagctgtccccacgcacccgactcgtcgccgtggacgccaagggcagcgccatcttcgacgaggcaggagcaccccatccccgctgtgtcccgggacacggtgcgtcagtgcgaccgccgctgtggcgcgcggggctcgccgaccaactggttctggtctccgacgcggactgcgtcgtgggatgccaggaggccctgcgcaccgaggctcttctcctcggcggatcctcgggagcaattctgacggccattcaccgagtgtctcccacgattcccgctggttccaccgtggtgacgatcctccccgacggcggcgagcgctacatcgacaccatctacagccgctcgtgggtcgactcacacatccccgggctgccctctctcgccgactggggggctcccaaccccgccaattcgtatgacctgaacagaagtgcctcatgaagctctacaccagagagaccgtcgaaactgcgcttgtcgggcgtcatggccaggttctcagtgccgtacagagtgcatacatgctgcattcgacgggagagacatcgctgccattctcaaccttcctccgcccggccgggtatccgaacgatcggatcatcgcacttcccgcccacatcggaggcgacttcgacatagccggtatcaagtggatctcatccttcccggaaaacctcgaccggggccagcaacgagcttcctccgtactcatcctcaatagtctggagacgggatacccgaccgccctgctggagtccagtcagatttcagcaacgcgaacggcagcatcagccgccctggccagcgccaccctccatggctccgaagaccatgtcagcacgattggcatcatcggctgcggaacaatcaatcttgcaacgatcgactacctcttccacgtgcacccccagatcaacgaggtcctctccttcgatctgaggcgggagcgggcccatgagttctcgcacctcgtcaaggcttcgcacccagaggcccgggtccgtgtcgccaaggagcccgacgagattctggccgcaagcaacaccatcgcgatcgccacgaccgactcgagtcattggttggaccttccgccgtggcacgggccggggcaccaagtcgtcctgcacacgtcgctgcgagacctgtcagtgccctcgatcctggcagcggccaacgtcgttgacgatcctgatcacgtctgccgtgaagcgacgtccttggatctggcaactcagcagaccggcaaccgggacttcatcacggggagaatcggagacctccttcttggcgcgccgctgtcctcaagtcctgactcccgtgtcattttctcacccttcgggctcggcatcctcgacctcgcagtcgcctccgtcgtcattgctgccgcctcctcttcagcagtcgagatcaatgggttcgaccccgggaaacacgccacaagcatgattgaggtgaatcgatgaccaccacacagatcaacgacaacacggccgttctgcgcgacgtattccccgccggctccgtcgcattcgtgagcggtgcctcacgcggaattggcgctgcctgcgcgacagcccttgcggccgcgggatgcaacctcgccatcacttatcgaaggaaggagaacgaggcggcacaaatcgccgaatccattgaagccatcgggcgccagtgcatcacaatgcagatggacgtaaccgatgagaaccaagtgaccagagccttccgcatcattcgccagcattacggacgcctggacgccgcggtcttgaactcgggaatcaccagtgacgggcatcttgcaacaatgagccgctccaagtggagctcggtgatcgacacgaatctgaccggaaccttcctctgcacgcgcgaggcgaccaaggccatgtactcgtccggtggctcgatcgtcatggtcgcgtccaccagtggagttgcagggcgaccgggccaggccaactacgcagccagcaagggcggaatcgttgccatgatgaagacgctggccccggaggttgcggcaaagaacgtccgggtgaatgcggtggcacccggcttcattcagaccgacatggtggcggccgttccaaaagcggcactcgcccaggcaatccaacacatccccatgggccgtcttggcctggcacaggaggttgcgtcagccgttaccttcctggcctccccgctcgccgcctacatcacagggaagaccctcactatcgatggcggaatgatcaacggctgaccccaggacccgcacacccccagtaccgagaaagaaacaacaatgaccgagatcacccacactgccaacagcatccgaacccgcgccgaggaacgttccaacaaagcttggcgcctgaaggaggagatcatctccaagctcggtctcgagaccaagccagaatatgtctcggacaaccaaccgctcttcggacgtggccttgagatggattcccttgacactctcgaagtcgtcgtcgccgtcaacaatgagttcggagtctcggtcaacgacgacgacgtacaggcgttcggctcgatcaatgccatggtcgatttcatcgaggtgaacgagaagtgagttctcttgcgctcgaggcgccacccaaggacgcccgtaagaaattcgcctacgacagcgatgccatcaagacgatgctcccacatcgttggccgatgctcatgattgatcgcgcctacgacgtcgtcccagggaaatcgggcaaaggcatcaagtcggtcagcgtcaatgagccgttcttcgccggtcactaccctgaccattccatcatgcccggcgtcatgatcgtcgagtcgatggctcaactcgtggccgtcatctacgtagccgaggccattcagaacaatcccggcatgacgtcgcacgacgcacgttcaagcgttggttatctcggcgcgatccgtcagatgaagttccgacgcctcgtcactccgggcgaccaactcaccctccacgcccagctcggcgagaaagtgggggctctgcgcgaggtttccgtgagagcactcaatggccgggatgtcgtcgcccagggggaactcgtcgtcaccgagcggtgacacccagccacacacgagaaggaagtcccatgatcgttcgcccctacaggccacgtgatgcggaagcgatcgtacatctctacaacagccattccgactcccccaatccagtgtcgggagggattgttgaggaggagttccagagggagctcgaagaacgtggttcgacagtgttcctagtggccgaggaggccggatccattgtcggcacattcgggatgttccgcacgaatggccgacacaccatggccgatgatgaagtcttcgccgacatgttctatgtcaccccgtcacatcgactctcgacagttccgggacagctaatcactgaagccatcagcgagtgcttcatccagggcatcaacgtgatccgcctcaccgtgaaccccgcgaacatctccgcgctcaaggtttacagaaaagtcggttgtgcctgtctcggggccaccgatgcaggcgaggacgggaacattgagctgtacaacttcatccctctggttcttagggcaaccatcaccaaactcgaccacgattgtattcgagccctggcggacatgacttcgttcgcctgcatcaccgagggacgtccacttgatctgtcccacgacttcatcgtggacgctggacggaagatcgtctcccacagcatccagatcgggcgttcaaccatccacgccatggtcgacacgggctcgaggaccattgtggaggccaccctcgacaaccgcgactgggatgctcctcgccagatcgtcgcccccaccccctgtcagaaccggcccgaggaacagcgaggcaaccctgtccggctggtgcacaagaagcttgaggtcaccttcaacgaaggagtcattgagatcagtacgactggccactggggcccggtcctcgcaatgtcctggccctcctccgtctcgcaccgcgctcacgggtggcgacagggccccgccaagtcgtatcgatgcgagcttctcgagaattgcctcgtcctggatgacgaaggaggagtgaaatgcaccatcagcctcaatgattgccaagtcgcgatccggatggatggtgccccaaaaacggaattgagaatgtaccagtggtgcagcctgcgccagggctatctgacggctgacaccggcatcacgagcttcaaccgggcatccagtgggctcggagtcgccgtccgggactcgtccgagattgtcgccgcgggccttcccgtcatccctgacacaccgatcacatggagtgagggtgacatcacggttcagctcgatccctgcggccgcgcctccctgatccactcgaccctggtggaccgaagaatccacttggacgagtctggctcggcaagtctcaccatgaccgtgtttggtgattcccagccccatcgtgccgacaccgtcgagctgcctcccctcgcggcaggcaccgacaggatcgtcctcaagccggctgccggaggcgtgaccacatggcgcttgggcgccaccaaggtgctcaagtcaccgtggccacacgcccgcgcgctcgggcccaatccgatctggcgagccggcctgtgggtcagtcacgagccggatcgccacgaccgtcgccaaggaatggggtggggtcccgatcatcgcagttggaccctgtcggaagacaccatgaccagtactgacgggacactctcctggcgcttcagcggctcccccgacaccggctggacggtcgacgtcacgacgagcaacacgcacggggagaccgtcgtctggctcaccccggactgcccggcgggcgagaggatccgcacgtctgatcatgccgtgacgaccatgcttgacatctcgaagccatggcagcgctggaccacccgatgcgcaattcctctcagacacgggaagtggttcctcatcgagcctgatcatgacctcactgattcccccgaaatcctcatgcgctctgttcacggggtcctgctcgtcggctgtgtcggacgagcccactccggatccgcttcctggcgctttgccatcacgtcagaactccccacctccaacccaagaagaaacgactacacctcagccgcctgaacccaaccagttggaacacccactacagaagaaatggagcaccaccatgtccatcactgagcagtacaagacccttcgcacctcggtcggcctccacacgcctaccggtcccctggtccgtatcaccggtgatgatcgtctcgagtttctcgacaccttcctgtcccgcgcctcggacttcgtggaccccgacaccactcgggagtgcctcgctctcaccgaggacggccttccgctgacgatcttcctccacatcgagcgcgaggaggagtcatggctccttccccgcaccgccatcgatgcggcgaccctcgccacgtacctcggcaacctcgagaccgatggtgacctgtcaatcgagattgctccagagggttggggagctgtcgctgtcgaggggccgctgtcgtggcagatcgccgaaaaccttctcgacttcgacgtggctggcctcgttcttcacgccgtcacggacgtcgtcgttcccggggcccccgagggatcgaaggcatggctcgcccgggtcggaaccactggagagtacggctacctgctcgtctccaacgttcccgacctcgcccgcacttatctcctcagccgcgccacggagctgggcggtcaggcagtcgacgccgatgctctcgcacgagtccaggccgaggccgggatgccctattacgcgatgggcgtgtgccacctcgatgtcgccgggggtgacctcgcctggctcgtggactggcagcgcatcggcgagttccaaggatccgagaatctgcccacacccgtccgagaccagcgccgactggccgccatcgccctgcccaccggcaaccgcccggaagctggtcagaccgtcgctgccggggatgaggagattggaatggtggtgtacgtcaccccgtccgccaatcccgatgaggaactcgcgttcgcacttctggatgctcctttctggactcccacccttccgttgaccgtcggtgcccacgacgggaccacggtcaccctgccccgcgtcgtggcagcctccagcctcaacaagatggggtgacagcgatgacgatcactgctgagaacgccaccacccgcagcgacattgcccggagcattgcggtgaccggcgtgggactggtcacggcacagggtgaccataccgacgagtgctggaccgaacttgtcgatggggtttgcggaatcaccatgaacgtcacgttcgatgactctggcaccacgattccgtgtgctggcgtggctcccattccgaactctgattcgatcgaccgctgttacctgctcggcgtccatgccatgcgtgaagctctcgagatgagtggcatcgacctggactccgtgggtcgtgatcgcatcggactcgtggtgggctcaagcctcggcgcgatgcccaccttggaggcggctcatcgccgggccattgagaccggcgtgctcgatgccggattggcggcagactcccagctccactgcgtcgccgaccacctcgccgctgagttcgacatccgtggaccccgcgtcgtgacatcgaatgcgtgtgccgctggtgccgtggcgatcggctacgccgcagaactcctctggtccgacgatgtggacctggtcgtctgtggcggtgtcgatccactggcccagatctctgccaatgggttcacgtgcctgggagctctcgacaatctcccatgcagcccgatggccggttcctccggtctgactctgggcgagggagccgggttcatggtcctcgagagaacagatgcggcggctgccagaggccaggaggtgatggccgaaatcgccggctacggcacaagttgtgatggttaccaccagactgccccggacccgggtggcaatggcgcccgcagctcaatggaggccgccctgcgctcagctcatctcaagccgtccgacgtcagctacgtcaatctccacggcaccggtactccgaccaacgacgccgtcgagccgaaggcactccggtcattgttcaagtccgatgaccttccccctgtcagttcggtgaagggcgccatcggtcacactctcggcgctgctggcgccatcgaggccgtgtgctcgatcaaggccatccacgagggggtcctgccgccaaccgtcaacaaccgcgggcaggcttcccgaactggtctcgacatcgtgccggagtgcgcacgcaaggccgctcccgacgtggtcatctccaactccttcgccttcgggggcaacaacgcatcagtggtcatcaccgcacctcgaggaggcgttcactgtaccgccccggcgcagcttcgcgaggtcggaatctcaggaatggcagctctggcgggaaaggccgccaactcggaggagcttctttcggccctgtcagaagattgtccaatctggatggccgatgagaagacctgggaaggggatgctgtccaaaccggccatgtggacatcaagcgcctgtcccgcacaatcaacccgtccaaggttcgtcggatggaccccttgggaatcatctccagcgcggtggtgactgatctgtatgcccgacacgggaagctgagccgcaaggatgccgaaagcacgggaatcatcttcgcaaccggctacggtcctgtgacggcggtgacgcagttcaatgacgggatcatccgccacggttccgagggtgccaacgccctggtgttcccgaacaccgtggtcaacgcagccgcaggccacctcgcgatgctgaatcgctaccgtggttacacggccaccttggcatgcggtggaaccagttcactcatggcgctgcttctcgctgctcgcgtcgttggccgcggcgctgcggatcgcatcatggtcgttatcgctgacgagtttcccagcattgccgtccaggccgtcgcgaagcttcctggctaccgacacagggttgatggttccggagccgtgctctcggaaggcgcggtatgcgtcctggtggaggccgtcgaagtcgccgaagcacgcggtaccgcccccatggcgctgctacgcggcttcggatcccgtggagagtccgtgggagtcggtcacaccgcatccgatggacgggcttgggccaaggccatggccgctgcactgggcccggccggcctgactgcctccgacgtgtcgaccgtcgtggcggcatcaagcggacatcctcgcgtcgaccgagccgagcaggcggccaggcggatcgtcggactgtccgcaaccgctacgaccttcccaaaggcgattgtcggagaaacacacggatcggctgccgggatcgggctgttcggtgccctgtgcggttcgaggtcagccgcgcaccagaacatccttgtcaacgccttttcccacggcggtggttatgcctcgatggtggtggagtcactgtgaccacgacgcttctgccacgggttgcccagccgggaccgggcgtcagccatgtcgacaccgaccgtcccatcgagtgcatcatcacccaccacccccacatgccgcgtgatcgcggaggccacgccacctccgtgtcaggcaggtacttgctgcgccaagccgcagaactcatgctcggcacggatcctgcgcattgccccgtcgtcgacccttcgcggcgctggtactggcccggaatcaatcttcacggttctgtctcccatgtcccgggctggagcctgacgacgctgagcaccggcggccacatcggggcagacatccaggacttccgggagcgtcccggcgcaatggcattcatcggtgacctggtcaagctgtcgcgatcggcgtcactccgagaattcgcggagtgcgaggccgtcgtcaaggtgtccgaattgactaaggagacgttcgggcacgtgcgactgcccgaatggacacccggatggcgccacgttttcgaggactactgggtctggagtctcgagatgcacgggatgggagtcatcgcactcgcatccgatctcccccgagccattcgctggtggcggtgcgacgccgatgcccgtggccgtctccaggctctccgacccataagcagtcttggaccaggaaggccgtcatgagccggtactcacgtcgaatctcaggcatcgaacgcggctatctcaacgccgcaacccggggcccgcaccccaccatccacacgatgatcgacttcgagggccgcgtccccgccgactgttggcggcacgcatccacgattgcgtcggccgccaaccctggcatgacagtggtccggaggtcgggccgatggacatccgatccagcgggctgtccggttgtgttccacgactggaccgcggaccccaacgacgttgccgacttccacgctgacatggatctcgtgacgggaccatcgtccacgctccacgttttcgagggggcggaacgcacccgaatcaccttggcagcaagccatgccgtgaccgatgggcggggcatcgaacgatttctcgtcgacctgcttgcagcgttggacgagcgtgaacccattggaagccccgacaccctgaccgatgtcgatatcaaacgatccttggagaacagcatcaagccccgacgccacctggccgctgtgcccgccgatgtcctttctccactgggggggaggaagaaccaacgtatatgggcctccaggacgtggcacagtgccccgggagccatgagcggaagaatcgctgccgctgtggccgagatgatcgaccacgccgcaatgatcatcatcccggttgacatccggcggcacgtcccagaggtccgatccacagcaaacctaagtgcccaactgccagtgatcatcaccccgaaccagcgctggcaaagcatccatgggcatctgctcacggaccttgctcgccatcgagaccttgcgatcatcagtgaggatttccgccacaacaatccgttcgcatcgaccttggaggaaagccaggccatcggcctcgatggtgtctatccctgtgccgcaatcatctccgaccacgggaagctcgacctttcaaggttccagaccttggaactcaccccggtctcgatgcgaagcctcccgatgctcgttccctactccgcaatgttcatcagcagttgcaccgtcggcgagaccaccactgtcaccatcgctcatcgcgctgatgacgatcccgattccataaacaccttcttccaccacatcgaatcccagatgtccatctgagccacgtcgtccctggagagcaaacatgaccacccaaaatgtcatcaccccgccgcgccccgtcacctcccatgccacggcgaccaggtccgaggctccaccgcgaagcgtcatcagagccatggccatctcgatggtcgcgaccctcatggtcatgctcgacacgaccgtcgtgaacgtgtccttgagcgcgaccaccgcccgcttcgggagcatgggcagcgtgcagtgggtcctcacaagttacctacttgcactgtgcgcgacgatgacggcctccgcctgggtcatcgaccgccttggtccacggctcaccttcatcgcctcaatgaccatgttcctcatcggctcggtgatgtgtgcactgagcgattcagtgtggcaactcgtcactggcaggaccatctccggtgccggagctgggatccttgttccgacagcatccgtcctgcttatccgtggcatcccacgcgaacaacttggcagggtgcaggcactgaatgggagtgtccagttgatcgctcccctgatcggcccgactgtgggcggtctcctcgttgacaggtgcgggggctggccggccatctactgggcgaacgtccccgtagctcttgttcttctgattgaggccgtccgcgtcgatccggacgaaccacacaccgctaagcgccgcctcgatgctctcggcctggtctgtggcagcaccgcgatcgtgctgacagtgcttggtgtctcactcttcggcaggacgtcgcgaaacaccaccttcctgcttacgatcggcgcgcttgcagtcctcgcatgggcgttcttcatcacccacatccgaagggctaccaaccctctgcttgacgtttccctgtatcagaaccctgtctattcatggtccagcttcaacgtagcggtgcttggtttcggtctctacgcccccatggtcgtcatgcccctctatctcgaggcgacgcgccacctcactgccgtccacactggtctggtgatgtcagtggccggcgtcggcgtcattatggccggaatcctgtgcacgaagatcatgggccggatcggtggaggcctcacgatgacagttggcataactctgagcatcatcgccactctgcccctggtccggctgacgaaccacacctcctacatactcctggcagtctgcttggccttgcgtggagcaggaatcagcctgacaatcgtcccagccatgacacgggccttcgagtccatcaagaggacggccatggcggacgcctctgcacagctcaacctgttgcagcgaatcggcgggacaattgcgacagcagtcatcatcgcagttatccaccacgaggccatgctcacccgcggactctcccccacagtgttctcgcacgccaacgtgtggatcctcaccgcgaccgccgtcacccttctgccggccttcgcgcttgcgaaggccgaaagacaacagcaggatctctgagcaccgaggagtactccctcgtagaccctcctctgatctaattgggttcgttccaagtgtgtatctcactccggggagccccgattgctgaaccacatcccgttcaccctggcgagtccctcgtggtacgacgtcccctgggcgcccggatctccgtatctcacaggagatatctcggtcctgccagcggactcgccaaggtggacgacgaccatccggggtccttggcaaatccacatgccacctcgtccgacccttccagaggtggggtggaaagtgcatgtgtctgccaagccatcggaattggaatcggttgcctcagtcgtagcactgtggtgcgtacgccacagcgtccccttcaaagtacttcgcacccgaggtctcgttcacgcgagtcaagtcaagtatgcggaccgaagtcagagcggcaaggtctgcacctgctaccccgacggcgagagccttgagcacttctgctccggtcttgccgagctgcttcagaacgtcgattcacctccggtgtccggcgagctgcgagtcggatcctcccctctgtggttgcgtcacgggagtttccgagaggcatgggcggtgtcatccacaggagtaccgttcccggtctacccgggaacaacacatcctgatcgtcgaggccccgcgcccgcagaatccgatcacgacacgccgtggatccggaggctccgtcggacgaatcgccccagcacggttcttcccatcgacgatgtcagactcctccaccgatcaaatgctggcggcgtgtatcaggcaacatggagagacggcacatcggtagtcgtcaaggaggcccggcacctgtccggacttgatgcggcgggtgtcgacgcccgagtgcggctgcgtcacgagtacgaggccctgagaagactggacccctatcgggccgctccccatcccattgatctcattgagaccgaggacggctcgttcctgatcatggaattccttgacggaatgacagtccaccaggagatgtcgaggttccatcctctgattagtaggcgacctcatcggctatcgatgaccgatttttcacgctggtgccgagaggtcgaagatcgcttgaggaatgtcacgagggtcatggccgggtgcggaatcgttcacggggatcttcatcccgcgaatctgatacatgtcggccatgaggttttggttactgactttgaatcctgctcaatcgacggggtcgccgtctcgtcagggatcgccgctccctggttccagtcggacgacacgattcccgatccggcgacgactgacgatctccacactcttctcgtggatccgacttgcggccccgcgcttgtcccccatccaaatcttcgcgcgctcatcagccaggccgcagtcgaggacatgatgggaaatccgactggtttaccacatgcctggaacctcgaggacatgacaagcgaactcgccaaggggatccgggcatcagccactcccgcacgagccgaccgcctctttccctcagacccctacctgttcgggcatccaggttcagaattcggcctgatgcatggcgccgccggaatcatggctgctcttgccgtgactgggtacggtgttgacgcgaatcacgtgacctggatgaaggaccgcttggccacccgcccgaccctgctgccggggttggccaacggaatcgagggaattgccctgggtctctccctgtgcggtcagaacgacatggctgcatccctgctccaccagtccggaattctcacgatcacaacgaacggatcgactgacctcaccctcggtactggtatggcgggccgagcgtgcgcgctgcagtccctctcacaacgactgtcatcgaaatctctcgcccacgctgcatataccctctgggaacaactcgccgtggctgtgcggaacactgatgtggccttgccgaacggcctgttctccggttgggagggaatcgggctctccctgcttgcctctcccctgccggatcgtcatgatctcgcccgccactcactccgactggccctggccacgacaacgattgttgacggtgcgctcttctcaggcgagggacagatccgatggccatatctggggcgtggtcccgcggcatgtggcccgctcgccgccaggcttgatgatgaccagacggccaaggccgtggcacagacctgtcgttgtcccctgactgagtcatccggtctccacaatggccgcgcaggtctcctactcgtcctccgccagctcgtgggagaccaagacgacgccgttcgccgccacctcatgagactgtcgtggtcgatggaccgtcgcgaggaaggcacattgctgctgggtgatcatggcctgcgtttctcatccgatctcgcgacggggtcagccggcgccctcctcgccctgagcagggacccatggcggaacatgacacgaatgctcggaatatgcgatgacacctgtcatggcccactagtgacagtttgatctagcgccgatagttcacaactgaaagactccaaacatcgaggaaaacatgctgagccaaaacgccttggcaggcgtggctcgtttcaccacgatgaacaccaggagacagaatgtccgttgaggccatgcaatccatcgagatggacgaggaaaacagcgccagccagacagtttgcgcttgttacagcttcttctcgtggtcaggatgctgcgtagtctcccaagcggtggaagcatcttgatcgtgtgagacgccgtcgactaccctgtcccccgtggtacgcacacgccccgtcctggacagtcccggaagaccgctcatcgcctccggagtcgtcctggcggtcctgctcatcatcgcggtgatgacgatggtgcttcagcgcgaccccactctcacccccggacgccgcattctcggtatcgtcctgtccacggtccaggccgtcggattcatgtggctgcagacccgcatggttcgtcacggcaagggttcgcgcaacatgcgtgcgacccttggaagggtcggtttctgggccacgtggggactcgtcgcagtgggagtcgtcaatctgtggctgaccaactcgtggaccctcttcggggcctccgtcgccacgcccctccttctcctgccaggggtgtggagtgtggtggccaccctcgtgaccctgatcgtcggtttctccgacctcgtggtcacccacacctcgccactgacctcagccacggtcgtgctggtgaccatcgcggtgtcggtgaacctctacgcattcacgaagctgtcgacggcactcgttgaactccgctcctcccaggaggagatcgcccggctgcgcgtggacgccgagcgtcaccggatatcgcgggacctccacgacatcatcggtcgcaccctggtcgccacgtcgatgcgccagcaggcggccctccacctcgtcgaccgcgacccgcaacgggccaaggaacagctcgacgccgcccatgacgcaatcaccgaggggcagcaccagttgcgttccatcatccaggccgagatgagcaccagcctccccgacgagatcagcgacgccacattcctgtgcgaccgactccacatcgacttccgcatggatgaccgcggcagaccgcacaaacccttcgactcggcggcggcggcggccctgcgcgagggaatcacgaacatgctcaagcacagcgcggcgggctactgccacgtcgccatctccccggacctcctgaccgtcaccaacgacggttgtccgcaatcacctcgcccctccaccacaccgggcaccggaatcgaccatctccggtcccagatcgaggcgctcggtgggtcggtgacgacgtcgcggccctcgcggggcaccttccggctccgctgctccttcccgacccggggggcgtccacgaccacacccgcgaccgaaggaggacgatgacgacgagaatcctcctcgccgaggacatcaaactggtggcagaggccttcgaggcactgctctcggtggaaccggagttcgaggtcgtcgcacgggtggcacgcggcgacgacctggtcacatccgccacccgcctgttccccgacgtgatcctggccgacatcgacatgcccgggatgaccggcatcgaggccacccgaatgcttcgcgacaagggataccgcggcagaatcatcctgctcaccgccctgccgggaagcgggcacctgcacgccgcgatggctgccggagccgacgggtacctgctcaagtcgatcaccgcgccctccctcatcaacgccatccgggcggtgtgcaacggccagtcggccatcgacccgaacgtcgccgcggtcgccatgcgcaagggaccctcgcccctcaacgaccgggaaaccgagattctgcgcctagtcgccgacggttcctccaccgcgcagatcgcctcgcggctgtacctcagcaagggcaccgtcaggaactacctgtcgacggcgatgtcgaagctcgacgccgactcacgcacagcggcggtcacgcgggcacgcgaggagggctggctgtagcaggcgacccgctcagcccaccgcccctcagcccgccgactcctgacgcacggcctcctcgaccgcccggctgagcagggacccggccctgaccatcgacgtctccgggtccggctcgagatcggacaacgcgatgatccggtcgaacgcggaccgtttctcctcgggcaggtcacagcgtccgcacaccgcccagacgggcaccccggcgtcccgggcgatcttgcggatggtgtcgggaagcttgccgagcagggtctgctggtccagccgcccctcccccgtgacgacgagactggaggcggagatccgcgacaccgcgcgggaccatcccaggacgaccgccgcgcccgggcggtacctggtccccaggcacatcagcgcccagccgacccggctgggcggctgcgaaccccctggccaccgcccggcaggcctttcccgaactcagcgaccccttgaaggagtcgacggcaacgatgaccggcgcattcggatcaggacgcatgggatcagcatgtcacgtcgatacggagcagtcgcgccgcctacccctagactcgggggcatggtcaaccgagtctacctgtccctgagcgttctcgccctcgtgctgtgggtggtcgcctaccgtcacatgccgggctgggccgcgggcatcaccctggtgggcatcgtcgtgctgtcgctgtggtgcgagtggtcgcgggtgcgcaccctggccaggatcggcaagtcccgccagcagggcccccgctcctcccgaggacgcaacctgtcgtgagcaatacgattcccgcagccctccaccccggccctgacgaggcc

SEQ ID NO: 33 - DNA, 88 bp, Propionibacterium acnes
agtcggtcccaagggttgggctgttcgcccattaaagcggcacgcgagctgggttcagaacgtcgtgagacagttcggtccctatccg

SEQ ID NO: 34 - DNA, 88 bp, Propionibacterium acnes; identical to SEQ ID NO: 33

SEQ ID NO: 35 - DNA, 88 bp, Propionibacterium acnes; identical to SEQ ID NO: 33

SEQ ID NO: 36 - DNA, 88 bp, Propionibacterium acnes; identical to SEQ ID NO: 33

SEQ ID NO: 37 - DNA, 88 bp, Propionibacterium avidum; identical to SEQ ID NO: 33

SEQ ID NO: 38 - DNA, 88 bp, Propionibacterium acidipropionici
agtcggtcccaagggttgggctgttcgcccattaaagcggcacgcgagctgggtttagaacgtcgtgagacagttcggtccctatccg

SEQ ID NO: 39 - DNA, 88 bp, Staphylococcus aureus
agtcggtcccaagggttgggctgttcgcccattaaagcggtacgcgagctgggttcagaacgtcgtgagacagttcggtccctatccg

SEQ ID NO: 40 - DNA, 88 bp, Staphylococcus aureus; identical to SEQ ID NO: 39

SEQ ID NO: 41 - DNA, 88 bp, Staphylococcus aureus; identical to SEQ ID NO: 39

SEQ ID NO: 42 - DNA, 88 bp, Staphylococcus epidermidis; identical to SEQ ID NO: 39

SEQ ID NO: 43 - DNA, 88 bp, Staphylococcus epidermidis; identical to SEQ ID NO: 39

SEQ ID NO: 44 - DNA, 32 bp, Propionibacterium acnes
caaccgtagatacagatacatctgaggagatc

SEQ ID NO: 45 - DNA, 12 bp, Propionibacterium acnes
catgaagaaaaa

SEQ ID NO: 46 - DNA, 7 bp, Propionibacterium acnes
ccgcgcc

SEQ ID NO: 47 - DNA, 18 bp, Propionibacterium acnes
tcaggttcgcaatgaaga

SEQ ID NO: 48 - DNA, 183 bp, Propionibacterium acnes
atgacagacaggtcctatccggcgatgatccggcttcggcgcaacgcctggaccgagttcgtcccgttcctggattacgacgtcgagatccgcaagatcctctgctcgacgaacgcgatcaagtcgttgaacacccgcttccgcacggtcatgcgggcgcagggtcatttcccgacgcgctga

SEQ ID NO: 49 - DNA, 26 bp, Propionibacterium acnes
caaccgcagatgcatctgagaagatc

SEQ ID NO: 50 - DNA, 12 bp, Propionibacterium acnes
catgaagaaaaa

SEQ ID NO: 51 - DNA, 2299 bp, Propionibacterium acnes
ttggtcagcgcccaccgatgccttacaccgtgacacgctcgaagtggcgatggaacacctacgcttcgaacctgattcgatcgcttcggtggcctcctgctgacgctttcatggatcgtgtcagcctggaggatggtaatgcgcccaaaactgtatgtcttcggtagatctgcacaagcggatcatctcgcgcaagaaggaaccgtgaggtactcgatccggtacactctccacatcaaaaccaacaatacaagtcacagtcatagatagttgtgtcattaacaagaaatcccaacagcaccccaatgcaaaattgcacagaacgacctagccagatgattttcagcaagtctaccatgacagcaaaggccgcagatagaaactgtgacatatacattgcacgctgaacttactaccccaccactaaatttacatagattccataccgacccgaacgccaccagtcaaccatcagtaatcatcatcgagaagtcaaaaataaccaacaccattgataagatccatgccatggacgggcagacgtctgtgatcagcagagtcgagaaacgaggtaaagcaaactatcacgagccaccagataatacccctagaagcttgtccaatatgttagctctggttaacatgccatcgccagcacaagattaacacgcttgttcatgtcttcagaaagcaacgaagctcgcctagatacttggacatttatatccttgcaaacccccccctaaagcctccaaaaatccttgatttacctcactaatataccattaatttgccccacctcaagccaacaaaagaacggagcatcagagccataggaagcctccgccagacataggggactaaacattatctccttctacgtcaccaactagaattcataaagcatcaacctacttatttaattcgatctaaaatccaatatccttagtatcagggatcaataaaaccaaaattaggaaacatacttaaaatcatgacatttcacttagtagacatactttgggattgtatcgacgcgtgacattgacacccatatttctgcggcagaatgcaccccggcaatccattgccaacatgcatgacacaccagcccatcagacccgaggtgaggtgatacactgttggagttagttcctggtacgcaaaccgcacagcccggtaggaagtccgggcggcgcaatagacgtccgtcgctcccctcatggagaatccagtgtcgccaggtccgcttcggcgtactgggagatgatatgcctacgatgttcactgtctacttcgatggccagttctgggtcggagtcctagagaggcgcgacgagggtttggtgcgtgccgtaaaagtcacgtttggcgccgaaccgtctgacacggaattgtacgagtgggttagccgtcatggcaacgcacttatagagcgattggagtctaccgctgctgtccctaccacccgcagtccccgagccaagcgactgaaccccaagagggcgttacgagatgcagcgcgagctgcccaagcaccccgtgccagcacggccgcacaggccgcgcttaaggccgatcaggaagctcggggtcgcgccgccacagtgaagcgcaagcaggcccggatcgacaaagctgcggagcagtgggctaagaaacgagagcgcgcgaaggcaaagcaccgtggccactaatgcgtcgaccgtgcccttcccaactgtgattcttggttcgggacctatggcttcacggtcaaggcggtcaaatcgctcacacatgagtactattcacccgacatgccatcgtctgggcaatcacccaactgcaagctgatgacgttttcctcctaggcttgatgcactagtttagtgtggacaggaagactcatggcgaagggaacggcctgttctcaagatcgccaccgcgaacgagattcacttcccacggtgtacgcatactaaggggcggagcttgtctgacatcatctgggccagcacgcacatggcccagatgatgcccaccggatggtgagcctgacccgtaacaagaacgcatcagcgagcacctcgccgacgcggctgcgcacgcggtcgtaacctcgccactgcctgcgtgaacaacgcgcttcggcgcattcaacacgccgtgaccgcggcgcccacggcttgcgcaaccgctacaactaccacctactgtcgcctcctggtcgttggcggcataacccataaccatcttcaaatccgaagcgccgagtcctgccataattcgaaccttcagcctgcatgactggaacaag

SEQ ID NO: 52 - DNA, 2299 bp, Propionibacterium acnes; identical to SEQ ID NO: 51

SEQ ID NO: 53 - DNA, 2299 bp, Propionibacterium acnes; identical to SEQ ID NO: 51

SEQ ID NO: 54 - DNA, 2298 bp, Propionibacterium acnes
ttggtcagcgcccaccgatgccttacaccgtgacacgctcgaagtggcgatggaacacctacgcttcgaacctgattcgatcgcttcggtggcctcctgctgacgctttcatggatcgtgtcagcctggaggatggtaatgcgcccaaaactgtatgtcttcggtagatctgcacaagcggatcatctcgcgcaagaaggaaccgtgaggtactcgatccggtacactctccacatcaaaaccaacaatacaagtcacagtcatagatagttgtgtcattaacaagaaatcccaacagcaccccaatgcaaaattgcacagaacgacctagccagatgattttcagcaagtctaccatgacagcaaaggccgcagatagaaactgtgacatatacattgcacgctgaacttactaccccaccactaaatttacatagattccataccgacccgaacgccaccagtcaaccatcagtaatcatcatcgagaagtcaaaaataaccaacaccattgataagatccatgccatggacgggcagacgtctgtgatcagcagagtcgagaaacgaggtaaagcaaactatcacgagccaccagataatacccctagaagcttgtccaatatgttagctctggttaacatgccatcgccagcacaagattaacacgcttgttcatgtcttcagaaagcaacgaagctcgcctagatacttggacatttatatccttgcaaaccccccctaaagcctccaaaaatccttgatttacctcactaatataccattaatttgccccacctcaagccaacaaaagaacggagcatcagagccataggaagcctccgccagacataggggactaaacattatctccttctacgtcaccaactagaattcataaagcatcaacctacttatttaattcgatctaaaatccaatatccttagtatcagggatcaataaaaccaaaattaggaaacatacttaaaatcatgacatttcacttagtagacatactttgggattgtatcgacgcgtgacattgacacccatatttctgcggcagaatgcaccccggcaatccattgccaacatgcatgacacaccagcccatcagacccgaggtgaggtgatacactgttggagttagttcctggtacgcaaaccgcacagcccggtaggaagtccgggcggcgcaatagacgtccgtcgctcccctcatggagaatccagtgtcgccaggtccgcttcggcgtactgggagatgatatgcctacgatgttcactgtctacttcgatggccagttctgggtcggagtcctagagaggcgcgacgagggtttggtgcgtgccgtaaaagtcacgtttggcgccgaaccgtctgacacggaattgtacgagtgggttagccgtcatggcaacgcacttatagagcgattggagtctaccgctgctgtccctaccacccgcagtccccgagccaagcgactgaaccccaagagggcgttacgagatgcagcgcgagctgcccaagcaccccgtgccagcacggccgcacaggccgcgcttaaggccgatcaggaagctcggggtcgcgccgccacagtgaagcgcaagcaggcccggatcgacaaagctgcggagcagtgggctaagaaacgagagcgcgcgaaggcaaagcaccgtggccactaatgcgtcgaccgtgcccttcccaactgtgattcttggttcgggacctatggcttcacggtcaaggcggtcaaatcgctcacacatgagtactattcacccgacatgccatcgtctgggcaatcacccaactgcaagctgatgacgttttcctcctaggcttgatgcactagtttagtgtggacaggaagactcatggcgaagggaacggcctgttctcaagatcgccaccgcgaacgagattcacttcccacggtgtacgcatactaaggggcggagcttgtctgacatcatctgggccagcacgcacatggcccagatgatgcccaccggatggtgagcctgacccgtaacaagaacgcatcagcgagcacctcgccgacgcggctgcgcacgcggtcgtaacctcgccactgcctgcgtgaacaacgcgcttcggcgcattcaacacgccgtgaccgcggcgcccacggcttgcgcaaccgctacaactaccacctactgtcgcctcctggtcgttggcggcataacccataaccatcttcaaatccgaagcgccgagtcctgccataattcgaaccttcagcctgcatgactggaacaag

SEQ ID NO: 55 - DNA, 6 bp, Propionibacterium acnes
cccgcc

SEQ ID NO: 56 - DNA, 18 bp, Propionibacterium acnes
tcaggttcgcaatgaaga

SEQ ID NO: 57 - DNA, 44 bp, Propionibacterium acnes
caaccgtagatacagatacatctgaggagatccatgaagaaaaa

SEQ ID NO: 58 - DNA, 38 bp, Propionibacterium acnes
caaccgcagatgcatctgagaagatccatgaagaaaaa

SEQ ID NO: 59-81 - skipped (23 entries)

SEQ ID NO: 82 - DNA, 6363 bp, Propionibacterium acnes; identical to SEQ ID NO: 29

SEQ ID NO: 83 - DNA, 6363 bp, Propionibacterium acnes
gtgttgtggactctcggggtcagtctgtccgctcacttgagatggcttaacatttctgaccgacgccgaagtctacgaacgctgcgaaacgccaaccgacgcctttgcaaccaagccttcttcatcaagatctacatcgacgaagacgaccaactccgcgtcgagaacaaccgacctttcgaaatgctcctcgaccctcagatcaacgccaacgccctcacctgggcccagaacggcaacaaggcccgaatcgaaactaaggggttcgagccttgtgcgtggggttacttagacgttcattttgatacaaggatctgggtgggtgcacggaggggctaggtgggtgcattgcatcctgacaggagcgccgggtgagttctggttgactaccagcagcgtgttcggtatgctagaggatagttacgcgacagcgtccgttccaatttctgggagtgtgttaattccgatggtgctgtgatctccgttcggctacgccgagaagcgtccaaatgtttcgacggttttggggatcaatatgtctgctatcgaggtaatcaatctttctttttcattttccgctcagccactcttggataacgtttcattcagcgttggcgatagcgagcgcgcagtacttgtggggcctaatggctctggcaaaaccactctcctgcgcctgatacgaggagagctaaccccggatcgaggacatatcgccatcagtgatgcaggagatgcaggttcttgtcgcttcccttatgttcgtgacgccactggcacagttcaggactatctggacgacgtgttggctggcccatgggagttgctcactcgcttcgaccacgtgacgaagcaactatcggctgcccaaagttcagcgagtctcgctaaagagtacgatcacatactcaccagtcttactctggccgacgtatggtcgctcgaagctcgaatcgatgaagtgttagccggtttaggtctaggccagctgaccggacgcggtcgacagcgcgcactcggctcactctcccctggccaggcagtgcggctcgaactggcaggcatcattatggtcagaccagtaactctggtcttggatgaacccaccaatcatcttgatgacgaagccgtaggctttctgatccagcaaataacagattggccggggccagtgctcatggccagtcataatcgtgcgtttattgaagagacagccacggtcatctatgacctcgatattgccccgtggcaggctttggccacagctgaaggagaggctgtgtctggcgtgtaccggtgcactggcgcctatagtgattatcttggcgccaaacaacacgcccgcatggagcatcaaaagcttcacgccacccagcaatctgaaaaacgcgcgattcgaagtcatcgccgtcgtagcgaagatatcgctcgtggtggagtgaaattagcgaaggcgcagggcatggcacgtaagttcttctctgaccgggcagaaaagaccgcgctgcgacgcacgcgtaacgacgatcaacgcttacacgatcttgctgaacatgaggtgcgaaaaccccgcaactaccaacttaagctcaaccttccaccagtcggctcgcgtggcgggttagccgtcacggcacgaagcgccttcattccaggcaggcttctcccaatcacgttcgaccttgccacgggggaacatttaatactgactggcccgaatggagcggggaaaaccacgctcttgaattggcttgctagtgggaaaacaacaatcgaccctagatccgaagccagcggcactatctctgtcagcgggcggcttgcttacgtcccacagcgcctaccacgcacaggagattcctactttcacccagaacattggaaagacgggatcagagaacttggcacgggaatactccacccatccatgtgggccaccccagtcggccaactttcagatggaaaccagcgtcgagcccagatcgcgttagccgtggcgcagaaacccgagattcttgtcattgacgaaccaaccaactacctcgacctcgccacgcttgaagaactagaggacgcgctacgccaatggaacggcacactcatcatcgccagtcacgaccgctggcttatcaaccactggcagggaacacaaatcgaattatgccccacagatccagcgcccggatcaccgaatcccctcttactcgttaagagccggttcgagccgtggtagtgccgtccttgagtgtgagtttgatagcgccgtcgtggttgacggtggtgtgatcgacgagggtgttccaggcttggtcggagtattcgagtggtggttgggtggcaaggtagtcgcgtacttcgattgcttgtgctcggcggtggcgcagatcgtcgatctggtcgctgatccgttgatgctcggcctcaagttggtggtgccgatcttcaagctcgtggtaacggcggtcgtagtcgtcagggtcgtgggcggtcgtggctgcggggtgatgagttggttcatcagcgtgatggtttcttcgatccgctcccccagcgtggcctgcttggtttcgagctcgcgggtgtcgtagacggtttcgtcgagcaggcgcatggtgtcatcgagcacgtcgttgccggtgacccgcttagccagggctgcgacgaaggcgtctttgatctggtcttcggtgacgtggggtgtcgcgcagtgatgatccttgttgtatttgttgttgcagcgccagatgtagcggcggtatttgctggtggagtgccagactttccgcccaaacctcccgccgcaatcggagcaggtgatcgtgttggcgaaggggtgggtgttggaggtgcctttgcctgcgcggcgggcgagttctgcttggacggtgtcccaggtgacgggatcaatgatgggttcgtggttgctggtgacgtagtactggggtacttcgccttcgttgattttcatggtttggttaggaagtcggtggtgaagctcttttgcagcagcgcgtcgcctttgtatttctcgttggcaaggatcgaccgcacagtggagggcgaccagatttgtttgccacgcggggtggggatgccatcggatgtgaattctttggcgatggtttgtggggttgcgccttcgaggaagcgggcataaatacgacggacggttggtgcttgggtttcgtcgatggcgaggttgccgtcttcgcctttcttgtagccgagcagggacgcgtaggacaccatgattttcccgtcggcgaagcgtttacggtggtcccaggtgacattctcggaaatggagcgggattcttcttgggtgaggctggacatgatggtgatgagtagttcgcctttggaatcgagtgtccagatgttttctttttcgaagtagacctctacgcctttgtctttgagctggcggacgtggatgagggtgtcgacggtgttgcgggcgaaccgggacacgctcttggtgaggatcaaatcgatttttccggcgagggtgtcggcgatcatggttttgaagccttcacggtgtttggtgctggtgccagtgatgccttcgtcggcgtacatgcctgcgaattcccactctgtgcgggattggatgtggctcgtgtagtagtcgatttgtgcctcgtaggaggaggcttgttcttccatctcggtggatacccgcgcgtaggccgctaccctgcgccgacgccgagtaccctgcaccgtggtgtgtccgggtatttttgtggctgggatcgcggtgacacgcttgttccgaatctgcttggtggtcatatcgcactttcctcgtccaggctcaccgccactggcacttcgccgctaatggtgtggatggtgagcgtacgatcgggattgacaacgattttcacgaggcgcgtcagcgcatactcgtcgtcccagtcgtcgaggccaagcacgcgggtgcagatctgggtgagatgggtttctcggatttgtggtgcctggcagggattgcctttacctttggtggcggtttcgcaccaccaaaacttgtaggacgtgtggcggcgtgtcttggtgcggcggtgataaaacctgctacagacagagcattcaatccgagaggtgagcccggtcgttctagctgacggcgtggctccacgtccgagatgtctgcgccgggcgagctcggcctggacggcgccgaacgtggtctggtcgatgatgggcgggtgggattcgtcgacgaggtagcgtggcagctcgccggtgttggtatggcagttcaattctgcaacgtttggccggtaatacttttgcaggattacgcggccggtgtagatttcattttcgagccatttgcggatcgtcttaccgcgaaacttggctccccgcctaggcttgaccccttcagcattcaactgactgatgatcttggcttcagtctcgatgatagccaagtcactacccacgtattggtagccgtagggttggcgcgaatgcatgagcccgtcggcgtatttcttccttatcccccatttaacattcttcgacatggatcgagattcctcctgcgcaaacgatgccagcagggtcagcaggagttcaccgtcagcggtcgcggtatcgatctgttcacgctcgaaacgcactgagacgccgaggattttgagttcgcggacggcatcgagcaggtcgacggtgttgcgagtcagcctggatatcgacttcgtcaaaatcatgtcgatgtcgccggagcgggcggcggccatcatggtctggaacccctctcgacggacggtactggtgccggtgatgccttcgtcgatgaacacgcctgcatagtcccaaccaggggtggattgaatcagatgagagtagtacgacacctgggcggcaatcgaagatagctggcgttcgtgctcggtcgatacccgcgcataccctgctactcgtagccgacgtggcgtggcgggtctaggtgggataactcgaaaactacgcgaggtcactccctgcttctctttcttctatggcgacaggtgttttggttgtatccatctacgctctaaacctgagtcttatccagtcgaacctgcagcaacaatgcccccactggcgcggttgcttcatgcccgatccgcgtaaggatcacgtggctttcgtttggggtgagtgcgccggtttcggtgagccgatcaataaaggcgacctggcgggcaagatcgacttcggcattgaacatggcacccgtcacggtctgccacctcgggtgctgaagcggtgcctgatatagcaggcatgcgagcaatacttacggtgcttgtttccgtaggcctcgaagctctcaccgcaagcaacgcaggtgaaggtgtatattgcccgccggttgagccgttcggggtgggcgtgctaccacgacaaacgacacacatccgaacagaacctttgccccgccaccgcagcttcaaaatgcccattacagtgttcgcatgccttagcaggctcaacatcaaccgccggatcgatgttgatgtcagctctgcgacagatcgacttcaccgtattgcgcgacatgcccaatctggtggcgatctgcccatacgatgcgcctcggcatcgcagctccacaactcgctcacgggtaatctcacgtgccatgacgcgctcctgctcaatagaaataaggtctctactgacagggcttcgacccaccccgatttataaccaccactgtcctggtgcgatgggaacaaaaatggccccgccaccacctcatgtagtgaggcagcgacggggcgaaacaggacagttttcatgagtcttggtttagtggcggagtttttcgttgacccggcgctggacggcgtcgtagttggatccgagtctgcgtcggcgttcgttgccgttgccgtattcgccgcggatgaccgcgtcagcgagcgcgtcaatgttcggtgccggcttcggtgtgggtgcgggtttcggtgccggcgcgggtgcgggcgtgttgccggtcatgtggtcgtaccagtactgggcgcgagccatataggcggcgtgctgagtaccggccagcgatgctgggcattcggtggctgagaagtttttgtgcccgaacacgttcttaccccaggtagggcggccgagcttgtaataccgacagatcgcggccaccaaatgtgcgccgttgtcgaggcaggcgtcagagattttccatgggttagaagaggcgtcggcgtgctcgataccaatgctggtggtattggctgcccagtttccggcgtgccaggcggtgtcgcggtcccacacgagctgcccgatccgcccggaggtttctacctggtagtgggcggaggcgggccgggtctgccacac

SEQ ID NO: 84 - DNA, 6363 bp, Propionibacterium acnes; identical to SEQ ID NO: 83

SEQ ID NO: 85 - DNA, 6363 bp, Propionibacterium acnes; identical to SEQ ID NO: 83

SEQ ID NO: 86 - DNA, 6363 bp, Propionibacterium acnes; identical to SEQ ID NO: 83

SEQ ID NO: 87 - DNA, 6363 bp, Propionibacterium acnes; identical to SEQ ID NO: 83

SEQ ID NO: 88 - DNA, 6363 bp, Propionibacterium acnes; identical to SEQ ID NO: 83

SEQ ID NO: 89 - DNA, 6363 bp, Propionibacterium acnes; identical to SEQ ID NO: 83

SEQ ID NO: 90 - DNA, 6363 bp, Propionibacterium acnes; identical to SEQ ID NO: 83

SEQ ID NO: 91 - DNA, 6363 bp, Propionibacterium acnes; identical to SEQ ID NO: 83

SEQ ID NO: 92 - DNA, 6363 bp, Propionibacterium acnes; identical to SEQ ID NO: 83

SEQ ID NO: 93 - DNA, 6363 bp, Propionibacterium acnes
gtgttgtggactctcggggtcagtctgtccgctcacttgagatggcttaacatttctgaccgacgccgaagtctacgaacgctgcgaaacgccaaccgacgcctttgcaaccaagccttcttcatcaagatctacatcgacgaagacgaccaactccgcgtcgagaacaaccgacctttcgaaatgctcctcgaccctcagatcaacgccaacgccctcacctgggcccagaacggcaacaaggcccgaatcgaaactaaggggttcgagccttgtgcgtggggttacttagacgttcattttgatacaaggatctgggtgggtgcacggaggggctaggtgggtgcattgcatcctgacaggagcgccgggtgagttctggttgactaccagcagcgtgttcggtatgctagaggatagttacgcgacagcgtccgttccaatttctgggagtgtgttaattccgatggtgctgtgatctccgttcggctacgccgagaagcgtccaaatgtttcgacggttttggggatcaatatgtctgctatcgaggtaatcaatctttctttttcattttccgctcagccactcttggataacgtttcattcagcgttggcgatagcgagcgcgcagtacttgtggggcctaatggctctggcaaaaccactctcctgcgcctgatacgaggagagctaaccccggatcgaggacatatcgccatcagtgatgcaggagatgcaggttcttgtcgcttcccttatgttcgtgacgccactggcacagttcaggactatctggacgacgtgttggctggcccatgggagttgctcactcgcttcgaccacgtgacgaagcaactatcggctgcccaaagttcagcgagtctcgctaaagagtacgatcacatactcaccagtcttactctggccgacgtatggtcgctcgaagctcgaatcgatgaagtgttagccggtttaggtctaggccagctgaccggacgcggtcgacagcgcgcactcggctcactctcccctggccaggcagtgcggctcgaactggcaggcatcattatggtcagaccagtaactctggtcttggatgaacccaccaatcatcttgatgacgaagccgtaggctttctgatccagcaaataacagattggccggggccagtgctcatggccagtcataatcgtgcgtttattgaagagacagccacggtcatctatgacctcgatattgccccgtggcaggctttggccacagctgaaggagaggctgtgtctggcgtgtaccggtgcactggcgcctatagtgattatcttggcgccaaacaacacgcccgcatggagcatcaaaagcttcacgccacccagcaatctgaaaaacgcgcgattcgaagtcatcgccgtcgtagcgaagatatcgctcgtggtggagtgaaattagcgaaggcgcagggcatggcacgtaagttcttctctgaccgggcagaaaagaccgcgctgcgacgcacgcgtaacgacgatcaacgcttacacgatcttgctgaacatgaggtgcgaaaaccccgcaactaccaacttaagctcaaccttccaccagtcggctcgcgtggcgggttagccgtcacggcacgaagcgccttcattccaggcaggcttctcccaatcacgttcgaccttgccacgggggaacatttaatactgactggcccgaatggagcggggaaaaccacgctcttgaattggcttgctagtgggaaaacaacaatcgaccctagatccgaagccagcggcactatctctgtcagcgggcggcttgcttacgtcccacagcgcctaccacgcacaggagattcctactttcacccagaacattggaaagacgggatcagagaacttggcacgggaatactccacccatccatgtgggccaccccagtcggccaactttcagatggaaaccagcgtcgagcccagatcgcgttagccgtggcgcagaaacccgagattcttgtcattgacgaaccaaccaactacctcgacctcgccacgcttgaagaactagaggacgcgctacgccaatggaacggcacactcatcatcgccagtcacgaccgctggcttatcaaccactggcagggaacacaaatcgaattatgccccacagatccagcgcccggatcaccgaatcccctcttactcgttaagagccggttcgagccgtggtagtgccgtccttgagtgtgagtttgatagcgccgtcgtggttgacggtggtgtgatcgacgagggtgttccaggcttggtcggagtattcgagtggtggttgggtggcaaggtagtcgcgtacttcgattgcttgtgctcggcggtggcgcagatcgtcgatctggtcgctgatccgttgatgctcggcctcaagttggtggtgccgatcttcaagctcgtggtaacggcggtcgtagtcgtcagggtcgtgggcggtcgtggctgcggggtgatgagttggttcatcagcgtgatggtttcttcgatccgctcccccagcgtggcctgcttggtttcgagctcgcgggtgtcgtagacggtttcgtcgagcaggcgcatggtgtcatcgagcacgtcgttgccggtgacccgcttagccagggctgcgacgaaggcgtctttgatctggtcttcggtgacgtggggtgtcgcgcagtgatgatccttgttgtatttgttgttgcagcgccagatgtagcggcggtatttgctggtggagtgccagactttccgcccaaacctcccgccgcaatcggagcaggtgatcgtgttggcgaaggggtgggtgttggaggtgcctttgcctgcgcggcgggcgagttctgcttggacggtgtcccaggtgacgggatcaatgatgggttcgtggttgctggtgacgtagtactggggtacttcgccttcgttgattttcatggtttggttaggaagtcggtggtgaagctcttttgcagcagcgcgtcgcctttgtatttctcgttggcaaggatcgaccgcacagtggagggcgaccagatttgtttgccacgcggggtggggatgccatcggatgtgaattctttggcgatggtttgtggggttgcgccttcgaggaagcgggcataaatacgacggacggttggtgcttgggtttcgtcgatggcgaggttgccgtcttcgcctttcttgtagccgagcagggacgcgtaggacaccatgattttcccgtcggcgaagcgtttacggtggtcccaggtgacattctcggaaatggagcgggattcttcttgggtgaggctggacatgatggtgatgagtagttcgcctttggaatcgagtgtccagatgttttctttttcgaagtagacctctacgcctttgtctttgagctggcggacgtggatgagggtgtcgacggtgttgcgggcgaaccgggacacgctcttggtgaggatcaaatcgatttttccggcgagggtgtcggcgatcatggttttgaagccttcacggtgtttggtgctggtgccagtgatgccttcgtcggcgtacatgcctgcgaattcccactctgtgcgggattggatgtggctcgtgtagtagtcgatttgtgcctcgtaggaggaggcttgttcttccatctcggtggatacccgcgcgtaggccgctaccctgcgccgacgccgagtaccctgcaccgtggtgtgtccgggtatttttgtggctgggatcgcggtgacacgcttgttccgaatctgcttggtggtcatatcgcactttcctcgtccaggctcaccgccactggcacttcgccgctaatggtgtggatggtgagcgtacgatcgggattgacaacgattttcacgaggcgcgtcagcgcatactcgtcgtcccagtcgtcgaggccaagcacgcgggtgcagatctgggtgagatgggtttctcggatttgtggtgcctggcagggattgcctttacctttggtggcggtttcgcaccaccaaaacttgtaggacgtgtggcggcgtgtcttggtgcggcggtgataaaacctgctacagacagagcattcaatccgagaggtgagcccggtcgttctagctgacggcgtggctccacgtccgagatgtctgcgccgggcgagctcggcctggacggcgccgaacgtggtctggtcgatgatgggcgggtgggattcgtcgacgaggtagcgtggcagctcgccggtgttggtatggcagttcaattctgcaacgtttggccggtaatacttttgcaggattacgcggccggtgtagatttcattttcgagccatttgcggatcgtcttaccgcgaaacttggctccccgcctaggcttgaccccttcagcattcaactgactgatgatcttggcttcagtctcgatgatagccaagtcactacccacgtattggtagccgtagggttggcgcgaatgcatgagcccgtcggcgtatttcttccttatcccccatttaacattcttcgacatggatcgagattcctcctgcgcaaacgatgccagcagggtcagcaggagttcaccgtcagcggtcgcggtatcgatctgttcacgctcgaaacgcactgagacgccgaggattttgagttcgcggacggcatcgagcaggtcgacggtgttgcgagtcagcctggatatcgacttcgtcaaaatcatgtcgatgtcgccggagcgggcggcggccatcatggtctggaacccctctcgacggacggtactggtgccggtgatgccttcgtcgatgaacacgcctgcatagtcccaaccaggggtggattgaatcagatgagagtagtacgacacctgggcggcaatcgaagatagctggcgttcgtgctcggtcgatacccgcgcataccctgctactcgtagccgacgtggcgtggcggggctaggtgggataactcgaaaactacgcgaggtcactccctgcttctctttcttctatggcgacaggtgttttggttgtatccatctacgctctaaacctgagtcttatccagtcgaacctgcagcaacaatgcccccactggcgcggttgcttcatgcccgatccgcgtaaggatcacgtggctttcgtttggggtgagtgcgccggtttcggtgagccgatcaataaaggcgacctggcgggcaagatcgacttcggcattgaacatggcacccgtcacggtctgccacctcgggtgctgaagcggtgcctgatatagcaggcatgcgagcaatacttacggtgcttgtttccgtaggcctcgaagctctcaccgcaagcaacgcaggtgaaggtgtatattgcccgccggttgagccgttcggggtgggcgtgctaccacgacaaacgacacacatccgaacagaacctttgccccgccaccgcagcttcaaaatgcccattacagtgttcgcatgccttagcaggctcaacatcaaccgccggatcgatgttgatgtcagctctgcgacagatcgacttcaccgtattgcgcgacatgcccaatctggtggcgatctgcccatacgatgcgcctcggcatcgcagctccacaactcgctcacgggtaatctcacgtgccatgacgcgctcctgctcaatagaaataaggtctctactgacagggcttcgacccaccccgatttataaccaccactgtcctggtgcgatgggaacaaaaatggccccgccaccacctcatgtagtgaggcagcgacggggcgaaacaggacagttttcatgagtcttggtttagtggcggagtttttcgttgacccggcgctggacggcgtcgtagttggatccgagtctgcgtcggcgttcgttgccgttgccgtattcgccgcggatgaccgcgtcagcgagcgcgtcaatgttcggtgccggcttcggtgtgggtgcgggtttcggtgccggcgcgggtgcgggcgtgttgccggtcatgtggtcgtaccagtactgggcgcgagccatataggcggcgtgctgagtaccggccagcgatgctgggcattcggtggctgagaagtttttgtgcccgaacacgttcttaccccaggtagggcggccgagcttgtaataccgacagatcgcggccaccaaatgtgcgccgttgtcgaggcaggcgtcagagattttccatgggttagaagaggcgtcggcgtgctcgataccaatgctggtggtattggctgcccagtttccggcgtgccaggcggtgtcgcggtcccacacgagctgcccgatccgcccggaggtttctacctggtagtgggcggaggcgggccgggtctgccacac

SEQ ID NO: 94 - DNA, 6363 bp, Propionibacterium acnes
gtgttgtggactctcggggtcagtctgtccgctcacttgagatggcttaacatttctgaccgacgccgaagtctacgaacgctgcgaaacgccaaccgacgcctttgcaaccaagccttcttcatcaagatctacatcgacgaagacgaccaactccgcgtcgagaacaaccgacctttcgaaatgctcctcgaccctcagatcaacgccaacgccctcacctgggcccagaacggcaacaaggcccgaatcgaaactaaggggttcgagccttgtgcgtggggttacttagacgttcattttgatacaaggatctgggtgggtgcacggaggggctaggtgggtgcattgcatcctgacaggagcgccgggtgagttctggttgactaccagcagcgtgttcggtatgctagaggatagttacgcgacagcgtccgttccaatttctgggagtgtgttaattccgatggtgctgtgatctccgttcggctacgccgagaagcgtccaaatgtttcgacggttttggggatcaatatgtctgctatcgaggtaatcaatctttctttttcattttccgctcagccactcttggataacgtttcattcagcgttggcgatagcgagcgcgcagtacttgtggggcctaatggctctggcaaaaccactctcctgcgcctgatacgaggagagctaaccccggatcgaggacatatcgccatcagtgatgcaggagatgcaggttcttgtcgcttcccttatgttcgtgacgccactggcacagttcaggactatctggacgacgtgttggctggcccatgggagttgctcactcgcttcgaccacgtgacgaagcaactatcggctgcccaaagttcagcgagtctcgctaaagagtacgatcacatactcaccagtcttactctggccgacgtatggtcgctcgaagctcgaatcgatgaagtgttagccggtttaggtctaggccagctgaccggacgcggtcgacagcgcgcactcggctcactctcccctggccaggcagtgcggctcgaactggcaggcatcattatggtcagaccagtaactctggtcttggatgaacccaccaatcatcttgatgacgaagccgtaggctttctgatccagcaaataacagattggccggggccagtgctcatggccagtcataatcgtgcgtttattgaagagacagccacggtcatctatgacctcgatattgccccgtggcaggctttggccacagctgaaggagaggctgtgtctggcgtgtaccggtgcactggcgcctatagtgattatcttggcgccaaacaacacgcccgcatggagcatcaaaagcttcacgccacccagcaatctgaaaaacgcgcgattcgaagtcatcgccgtcgtagcgaagatatcgctcgtggtggagtgaaattagcgaaggcgcagggcatggcacgtaagttcttctctgaccgggcagaaaagaccgcgctgcgacgcacgcgtaacgacgatcaacgcttacacgatcttgctgaacatgaggtgcgaaaaccccgcaactaccaacttaagctcaaccttccaccagtcggctcgcgtggcgggttagccgtcacggcacgaagcgccttcattccaggcaggcttctcccaatcacgttcgaccttgccacgggggaacatttaatactgactggcccgaatggagcggggaaaaccacgctcttgaattggcttgctagtgggaaaacaacaatcgaccctagatccgaagccagcggcactatctctgtcagcgggcggcttgcttacgtcccacagcgcctaccacgcacaggagattcctactttcacccagaacattggaaagacgggatcagagaacttggcacgggaatactccacccatccatgtgggccaccccagtcggccaactttcagatggaaaccagcgtcgagcccagatcgcgttagccgtggcgcagaaacccgagattcttgtcattgacgaaccaaccaactacctcgacctcgccacgcttgaagaactagaggacgcgctacgccaatggaacggcacactcatcatcgccagtcacgaccgctggcttatcaaccactggcagggaacacaaatcgaattatgccccacagatccagcgcccggatcaccgaatcccctcttactcgttaagagccggttcgagccgtggtagtgccgtccttgagtgtgagtttgatagcgccgtcgtggttgacggtggtgtgatcgacgagggtgttccaggcttggtcggagtattcgagtggtggttgggtggcaaggtagtcgcgtacttcgattgcttgtgctcggcggtggcgcagatcgtcgatctggtcgctgatccgttgatgctcggcctcaagttggtggtgccgatcttcaagctcgtggtaacggcgggcgtagtcgtcagggtcgtgggcggtcgtggctgcggggtgatgagttggttcatcagcgtgatggtttcttcgatccgctcccccagcgtggcctgcttggtttcgagctcgcgggtgtcgtagacggtttcgtcgagcaggcgcatggtgtcatcgagcacgtcgttgccggtgacccgcttagccagggctgcgacgaaggcgtctttgatctggtcttcggtgacgtggggtgtcgcgcagtgatgatccttgttgtatttgttgttgcagcgccagatgtagcggcggtatttgctggtggagtgccagactttccgcccaaacctcccgccgcaatcggagcaggtgatcgtgttggcgaaggggtgggtgttggaggtgcctttgcctgcgcggcgggcgagttctgcttggacggtgtcccaggtgacgggatcaatgatgggttcgtggttgctggtgacgtagtactggggtacttcgccttcgttgattttcatggtttggttaggaagtcggtggtgaagctcttttgcagcagcgcgtcgcctttgtatttctcgttggcaaggatcgaccgcacagtggagggcgaccagatttgtttgccacgcggggtggggatgccatcggatgtgaattctttggcgatggtttgtggggttgcgccttcgaggaagcgggcataaatacgacggacggttggtgcttgggtttcgtcgatggcgaggttgccgtcttcgcctttcttgtagccgagcagggacgcgtaggacaccatgattttcccgtcggcgaagcgtttacggtggtcccaggtgacattctcggaaatggagcgggattcttcttgggtgaggctggacatgatggtgatgagtagttcgcctttggaatcgagtgtccagatgttttctttttcgaagtagacctctacgcctttgtctttgagctggcggacgtggatgagggtgtcgacggtgttgcgggcgaaccgggacacgctcttggtgaggatcaaatcgatttttccggcgagggtgtcggcgatcatggttttgaagccttcacggtgtttggtgctggtgccagtgatgccttcgtcggcgtacatgcctgcgaattcccactctgtgcgggattggatgtggctcgtgtagtagtcgatttgtgcctcgtaggaggaggcttgttcttccatctcggtggatacccgcgcgtaggccgctaccctgcgccgacgccgagtaccctgcaccgtggtgtgtccgggtatttttgtggctgggatcgcggtgacacgcttgttccgaatctgcttggtggtcatatcgcactttcctcgtccaggctcaccgccactggcacttcgccgctaatggtgtggatggtgagcgtacgatcgggattgacaacgattttcacgaggcgcgtcagcgcatactcgtcgtcccagtcgtcgaggccaagcacgcgggtgcagatctgggtgagatgggtttctcggatttgtggtgcctggcagggattgcctttacctttggtggcggtttcgcaccaccaaaacttgtaggacgtgtggcggcgtgtcttggtgcggcggtgataaaacctgctacagacagagcattcaatccgagaggtgagcccggtcgttctagctgacggcgtggctccacgtccgagatgtctgcgccgggcgagctcggcctggacggcgccgaacgtggtctggtcgatgatgggcgggtgggattcgtcgacgaggtagcgtggcagctcgccggtgttggtatggcagttcaattctgcaacgtttggccggtaatacttttgcaggattacgcggccggtgtagatttcattttcgagccatttgcggatcgtcttaccgcgaaacttggctccccgcctaggcttgaccccttcagcattcaactgactgatgatcttggcttcagtctcgatgatagccaagtcactacccacgtattggtagccgtagggttggcgcgaatgcatgagcccgtcggcgtatttcttccttatcccccatttaacattcttcgacatggatcgagattcctcctgcgcaaacgatgccagcagggtcagcaggagttcaccgtcagcggtcgcggtatcgatctgttcacgctcgaaacgcactgagacgccgaggattttgagttcgcggacggcatcgagcaggtcgacggtgttgcgagtcagcctggatatcgacttcgtcaaaatcatgtcgatgtcgccggagcgggcggcggccatcatggtctggaacccctctcgacggacggtactggtgccggtgatgccttcgtcgatgaacacgcctgcatagtcccaaccaggggtggattgaatcagatgagagtagtacgacacctgggcggcaatcgaagatagctggcgttcgtgctcggtcgatacccgcgcataccctgctactcgtagccgacgtggcgtggcgggtctaggtgggataactcgaaaactacgcgaggtcactccctgcttctctttcttctatggcgacaggtgttttggttgtatccatctacgctctaaacctgagtcttatccagtcgaacctgcagcaacaatgcccccactggcgcggttgcttcatgcccgatccgcgtaaggatcacgtggctttcgtttggggtgagtgcgccggtttcggtgagccgatcaataaaggcgacctggcgggcaagatcgacttcggcattgaacatggcacccgtcacggtctgccacctcgggtgctgaagcggtgcctgatatagcaggcatgcgagcaatacttacggtgcttgtttccgtaggcctcgaagctctcaccgcaagcaacgcaggtgaaggtgtatattgcccgccggttgagccgttcggggtgggcgtgctaccacgacaaacgacacacatccgaacagaacctttgccccgccaccgcagcttcaaaatgcccattacagtgttcgcatgccttagcaggctcaacatcaaccgccggatcgatgttgatgtcagctctgcgacagatcgacttcaccgtattgcgcgacatgcccaatctggtggcgatctgcccatacgatgcgcctcggcatcgcagctccacaactcgctcacgggtaatctcacgtgccatgacgcgctcctgctcaatagaaataaggtctctactgacagggcttcgacccaccccgatttataaccaccactgtcctggtgcgatgggaacaaaaatggccccgccaccacctcatgtagtgaggcagcgacggggcgaaacaggacagttttcatgagtcttggtttagtggcggagtttttcgttgacccggcgctggacggcgtcgtagttggatccgagtctgcgtcggcgttcgttgccgttgccgtattcgccgcggatgaccgcgtcagcgagcgcgtcaatgttcggtgccggcttcggtgtgggtgcgggtttcggtgccggcgcgggtgcgggcgtgttgccggtcatgtggtcgtaccagtactgggcgcgagccatataggcggcgtgctgagtaccggccagcgatgctgggcattcggtggctgagaagtttttgtgcccgaacacgttcttaccccaggtagggcggccgagcttgtaataccgacagatcgcggccaccaaatgtgcgccgttgtcgaggcaggcgtcagagattttccatgggttagaagaggcgtcggcgtgctcgataccaatgctggtggtattggctgcccagtttccggcgtgccaggcggtgtcgcggtcccacacgagctgcccgatccgcccggaggtttctacctggtagtgggcggaggcgggccgggtctgccacac

SEQ ID NO: 95 - DNA, 6363 bp, Propionibacterium acnes
gtgttgtggactctcggggtcagtctgtccgctcacttgagatggcttaacatttctgaccgacgccgaagtctacgaacgctgcgaaacgccaaccgacgcctttgcaaccaagccttcttcatcaagatctacatcgacgaagacgaccaactccgcgtcgagaacaaccgacctttcgaaatgctcctcgaccctcagatcaacgccaacgccctcacctgggcccagaacggcaacaaggcccgaatcgaaactaaggggttcgagccttgtgcgtggggttacttagacgttcattttgatacaaggatctgggtgggtgcacggaggggctaggtgggtgcattgcatcctgacaggagcgccgggtgagttctggttgactaccagcagcgtgttcggtatgctagaggatagttacgcgacagcgtccgttccaatttctgggagtgtgttaattccgatggtgctgtgatctccgttcggctacgccgagaagcgtccaaatgtttcgacggttttggggatcaatatgtctgctatcgaggtaatcaatctttctttttcattttccgctcagccactcttggataacgtttcattcagcgttggcgatagcgagcgcgcagtacttgtggggcctaatggctctggcaaaaccactctcctgcgcctgatacgaggagagctaaccccggatcgaggacatatcgccatcagtgatgcaggagatgcaggttcttgtcgcttcccttatgttcgtgacgccactggcacagttcaggactatctggacgacgtgttggctggcccatgggagttgctcactcgcttcgaccacgtgacgaagcaactatcggctgcccaaagttcagcgagtctcgctaaagagtacgatcacatactcaccagtcttactctggccgacgtatggtcgctcgaagctcgaatcgatgaagtgttagccggtttaggtctaggccagctgaccggacgcggtcgacagcgcgcactcggctcactctcccctggccaggcagtgcggctcgaactggcaggcatcattatggtcagaccagtaactctggtcttggatgaacccaccaatcatcttgatgacgaagccgtaggctttctgatccagcaaataacagattggccggggccagtgctcatggccagtcataatcgtgcgtttattgaagagacagccacggtcatctatgacctcgatattgccccgtggcaggctttggccacagctgaaggagaggctgtgtctggcgtgtaccggtgcactggcgcctatagtgattatcttggcgccaaacaacacgcccgcatggagcatcaaaagcttcacgccacccagcaatctgaaaaacgcgcgattcgaagtcatcgccgtcgtagcgaagatatcgctcgtggtggagtgaaattagcgaaggcgcagggcatggcacgtaagttcttctctgaccgggcagaaaagaccgcgctgcgacgcacgcgtaacgacgatcaacgcttacacgatcttgctgaacatgaggtgcgaaaaccccgcaactaccaacttaagctcaaccttccaccagtcggctcgcgtggcgggttagccgtcacggcacgaagcgccttcattccaggcaggcttctcccaatcacgttcgaccttgccacgggggaacatttaatactgactggcccgaatggagcggggaaaaccacgctcttgaattggcttgctagtgggaaaacaacaatcgaccctagatccgaagccagcggcactatctctgtcagcgggcggcttgcttacgtcccacagcgcctaccacgcacaggagattcctactttcacccagaacattggaaagacgggatcagagaacttggcacgggaatactccacccatccatgtgggccaccccagtcggccaactttcagatggaaaccagcgtcgagcccagatcgcgttagccgtggcgcagaaacccgagattcttgtcattgacgaaccaaccaactacctcgacctcgccacgcttgaagaactagaggacgcgctacgccaatggaacggcacactcatcatcgccagtcacgaccgctggcttatcaaccactggcagggaacacaaatcgaattatgccccacagatccagcgcccggatcaccgaatcccctcttactcgttaagagccggttcgagccgtggtagtgccgtccttgagtgtgagtttgatagcgccgtcgtggttgacggtggtgtgatcgacgagggtgttccaggcttggtcggagtattcgagtggtggttgggtggcaaggtagtcgcgtacttcgattgcttgtgctcggcggtggcgcagatcgtcgatctggtcgctgatccgttgatgctcggcctcaagttggtggtgccgatcttcaagctcgtggtaacggcggtcgtagtcgtcagggtcgtgggcggtcgtggctgcggggtgatgagttggttcatcagcgtgatggtttcttcgatccgctcccccagcgtggcctgcttggtttcgagctcgcgggtgtcgtagacggtttcgtcgagcaggcgcatggtgtcatcgagcacgtcgttgccggtgacccgcttagccagggctgcgacgaaggcgtctttgatctggtcttcggtgacgtggggtgtcgcgcagtgatgatccttgttgtatttgttgttgcagcgccagatgtagcggcggtatttgctggtggagtgccagactttccgcccaaacctcccgccgcaatcggagcaggtgatcgtgttggcgaaggggtgggtgttggaggtgcctttgcctgcgcggcgggcgagttctgcttggacggtgtcccaggtgacgggatcaatgatgggttcgtggttgctggtgacgtagtactggggtacttcgccttcgttgattttcatggtttggttaggaagtcggtggtgaagctcttttgcagcagcgcgtcgcctttgtatttctcgttggcaaggatcgaccgcacagtggagggcgaccagatttgtttgccacgcggggtggggatgccatcggatgtgaattctttggcgatggtttgtggggttgcgccttcgaggaagcgggcataaatacgacggacggttggtgcttgggtttcgtcgatggcgaggttgccgtcttcgcctttcttgtagccgagcagggacgcgtaggacaccatgattttcccgtcggcgaagcgtttacggtggtcccaggtgacattctcggaaatggagcgggattcttcttgggtgaggctggacatgatggtgatgagtagttcgcctttggaatcgagtgtccagatgttttctttttcgaagtagacctctacgcctttgtctttgagctggcggacgtggatgagggtgtcgacggtgttgcgggcgaaccgggacacgctcttggtgaggatcaaatcgatttttccggcgagggtgtcggcgatcatggttttgaagccttcacggtgtttggtgctggtgccagtgatgccttcgtcggcgtacatgcctgcgaattcccactctgtgcgggattggatgtggctcgtgtagtagtcgatttgtgcctcgtaggaggaggcttgttcttccatctcggtggatacccgcgcgtaggccgctaccctgcgccgacgccgagtaccctgcaccgtggtgtgtccgggtatttttgtggctgggatcgcggtgacacgcttgttccgaatctgcttggtggtcatatcgcactttcctcgtccaggctcaccgccactggcacttcgccgctaatggtgtggatggtgagcgtacgatcgggattgacaacgattttcacgaggcgcgtcagcgcatactcgtcgtcccagtcgtcgaggccaagcacgcgggtgcagatctgggtgagatgggtttctcggatttgtggtgcctggcagggattgcctttacctttggtggcggtttcgcaccaccaaaacttgtaggacgtgtggcggcgtgtcttggtgcggcggtgataaaacctgctacagacagagcattcaatccgagaggtgagcccggtcgttctagctgacggcgtggctccacgtccgagatgtctgcgccgggcgagctcggcctggacggcgccgaacgtggtctggtcgatgatgggcgggtgggattcgtcgacgaggtagcgtggcagctcgccggtgttggtatggcagttcaattctgcaacgtttggccggtaatacttttgcaggattacgcggccggtgtagatttcattttcgagccatttgcggatcgtcttaccgcgaaacttggctccccgcctaggcttgaccccttcagcattcaactgactgatgatcttggcttcagtctcgatgatagccaagtcactacccacgtattggtagccgtagggttggcgcgaatgcatgagcccgtcggcgtatttcttccttatcccccatttaacattcttcgacatggatcgagattcctcctgcgcaaacgatgccagcagggtcagcaggagttcaccgtcagcggtcgcggtatcgatctgttcacgctcgaaacgcactgagacgccgaggattttgagttcgcggacggcatcgagcaggtcgacggtgttgcgagtcagcctggatatcgacttcgtcaaaatcatgtcgatgtcgccggagcgggcggcggccatcatggtctggaacccctctcgacggacggtactggtgccggtgatgccttcgtcgatgaacacgcctgcatagtcccaaccaggggtggattgaatcagatgagagtagtacgacacctgggcggcaatcgaagatagctggcgttcgtgctcggtcgatacccgcgcataccctgctactcgtagccgacgtggcgtggcggggctaggggggataactcgaaaactacgcgaggtcactccctgcttctctttcttctatggcgacaggtgttttggttgtatccatctacgctctaaacctgagtcttatccagtcgaacctgcagcaacaatgcccccactggcgcggttgcttcatgcccgatccgcgtaaggatcacgtggctttcgtttggggtgagtgcgccggtttcggtgagccgatcaataaaggcgacctggcgggcaagatcgacttcggcattgaacatggcacccgtcacggtctgccacctcgggtgctgaagcggtgcctgatatagcaggcatgcgagcaatacttacggtgcttgtttccgtaggcctcgaagctctcaccgcaagcaacgcaggtgaaggtgtatattgcccgccggttgagccgttcggggtgggcgtgctaccacgacaaacgacacacatccgaacagaacctttgccccgccaccgcagcttcaaaatgcccattacagtgttcgcatgccttagcaggctcaacatcaaccgccggatcgatgttgatgtcagctctgcgacagatcgacttcaccgtattgcgcgacatgcccaatctggtggcgatctgcccatacgatgcgcctcggcatcgcagctccacaactcgctcacgggtaatctcacgtgccatgacgcgctcctgctcaatagaaataaggtctctactgacagggcttcgacccaccccgatttataaccaccactgtcctggtgcgatgggaacaaaaatggccccgccaccacctcatgtagtgaggcagcgacggggcgaaacaggacagttttcatgagtcttggtttagtggcggagtttttcgttgacccggcgctggacggcgtcgtagttggatccgagtctgcgtcggcgttcgttgccgttgccgtattcgccgcggatgaccgcgtcagcgagcgcgtcaatgttcggtgccggcttcggtgtgggtgcgggtttcggtgccggcgcgggtgcgggcgtgttgccggtcatgtggtcgtaccagtactgggcgcgagccatataggcggcgtgctgagtaccggccagcgatgctgggcattcggtggctgagaagtttttgtgcccgaacacgttcttaccccaggtagggcggccgagcttgtaataccgacagatcgcggccaccaaatgtgcgccgttgtcgaggcaggcgtcagagattttccatgggttagaagaggcgtcggcgtgctcgataccaatgctggtggtattggctgcccagtttccggcgtgccaggcggtgtcgcggtcccacacgagctgcccgatccgcccggaggtttctacctggtagtgggcggaggcgggccgggtctgccacac

SEQ ID NO: 96 - DNA, 6363 bp, Propionibacterium acnes; identical to SEQ ID NO: 95

SEQ ID NO: 97 - DNA, 6363 bp, Propionibacterium acnes
gtgttgtggactctcggggtcagtctgtccgctcacttgagatggcttaacatttctgaccgacgccgaagtctacgaacgctgcgaaacgccaaccgacgcctttgcaaccaagccttcttcatcaagatctacatcgacgaagacgaccaactccgcgtcgagaacaaccgacctttcgaaatgctcctcgaccctcagatcaacgccaacgccctcacctgtgcccagaacggcaacaaggcccgaatcgaaactaaggggttcgagccttgtgcgtggggttacttagacgttcattttgatacaaggatctgggtgggtgcacggaggggctaggtgggtgcattgcatcctgacaggagcgccgggtgagttctggttgactaccggcagcgtgttcggtatgctagaggatagttacgcgacagcgtccgttccaatttctgggagtgtgttaattccgatggtgctgtgatctccgttcggctacgccgagaagcgtccaaatgtttcgacggttttggggatcaatatgtctgctatcgaggtaatcaatctttctttttcattttccgctcagccactcttggataacgtttcattcagcgttggcgatagcgagcgcgcagtacttgtggggcctaatggctctggcaaaaccactctcctgcgcctgatacgaggagagctaaccccggatcgaggacatatcgccatcagtgatgcaggagatgcaggttcttgtcgcttcccttatgttcgtgacgccactggcacagttcaggactatctggacgacgtgttggctggcccatgggagttgctcactcgcttcgaccacgtgacgaagcaactatcggctgcccaaagttcagcgagtctcgctaaagagtacgatcacatactcaccagtcttactctggccgacgtatggtcgctcgaagctcgaatcgatgaagtgttagccggtttaggtctaggccagctgaccggacgcggtcgacagcgcgcactcggctcactctcccctggccaggcagtgcggctcgaactggcaggcatcattatggtcagaccagtaactctggtcttggatgaacccaccaatcatcttgatgacgaagccgtaggctttctgatccagcaaataacagattggccggggccagtgctcatggccagtcataatcgtgcgtttattgaagagacagccacggtcatctatgacctcgatattgccccgtggcaggctttggccacagctgaaggagaggctgtgtctggcgtgtaccggtgcactggcgcctatagtgattatcttggcgccaaacaacacgcccgcatggagcatcaaaagcttcacgccacccagcaatctgaaaaacgcgcgattcgaagtcatcgccgtcgtagcgaagatatcgctcgtggtggagtgaaattagcgaaggcgcagggcatggcacgtaagttcttctctgaccgggcagaaaagaccgcgctgcgacgcacgcgtaacgacgatcaacgcttacacgatcttgctgaacatgaggtgcgaaaaccccgcaactaccaacttaagctcaaccttccaccagtcggctcgcgtggcgggttagccgtcacggcacgaagcgccttcattccaggcaggcttctcccaatcacgttcgaccttgccacgggggaacatttaatactgactggcccgaatggagcggggaaaaccacgctcttgaattggcttgctagtgggaaaacaacaatcgaccctagatccgaagccagcggcactatctctgtcagcgggcggcttgcttacgtcccacagcgcctaccacgcacaggagattcctactttcacccagaacattggaaagacgggatcagagaacttggcacgggaatactccacccatccatgtgggccaccccagtcggccaactttcagatggaaaccagcgtcgagcccagatcgcgttagccgtggcgcagaaacccgagattcttgtcattgacgaaccaaccaactacctcgacctcgccacgcttgaagaactagaggacgcgctacgccaatggaacggcacactcatcatcgccagtcacgaccgctggcttatcaaccactggcagggaacacaaatcgaattatgccccacagatccagcgcccggatcaccgaatcccctcttactcgttaagagccggttcgagccgtggtagtgccgtccttgagtgtgagtttgatagcgccgtcgtggttgacggtggtgtgatcgacgagggtgttccaggcttggtcggagtattcgagtggtggttgggtggcaaggtagtcgcgtacttcgattgcttgtgctcggcggtggcgcagatcgtcgatctggtcgctgatccgttgatgctcggcctcaagttggtggtgccgatcttcaagctcgtggtaacggcggtcgtagtcgtcagggtcgtgggcggtcgtggctgcggggtgatgagttggttcatcagcgtgatggtttcttcgatccgctcccccagcgtggcctgcttggtttcgagctcgcgggtgtcgtagacggtttcgtcgagcaggcgcatggtgtcatcgagcacgtcgttgccggtgacccgcttagccagggctgcgacgaaggcgtctttgatctggtcttcggtgacgtggggtgtcgcgcagtgatgatccttgttgtatttgttgttgcagcgccagatgtagcggcggtatttgctggtggagtgccagactttccgcccaaacctcccgccgcaatcggagcaggtgatcgtgttggcgaaggggtgggtgttggaggtgcctttgcctgcgcggcgggcgagttctgcttggacggtgtcccaggtgacgggatcaatgatgggttcgtggttgctggtgacgtagtactggggtacttcgccttcgttgattttcatggtttggttaggaagtcggtggtgaagctcttttgcagcagcgcgtcgcctttgtatttctcgttggcaaggatcgaccgcacagtggagggcgaccagatttgtttgccacgcggggtggggatgccatcggatgtgaattctttggcgatggtttgtggggttgcgccttcgaggaagcgggcataaatacgacggacggttggtgcttgggtttcgtcgatggcgaggttgccgtcttcgcctttcttgtagccgagcagggacgcgtaggacaccatgattttcccgtcggcgaagcgtttacggtggtcccaggtgacattctcggaaatggagcgggattcttcttgggtgaggctggacatgatggtgatgagtagttcgcctttggaatcgagtgtccagatgttttctttttcgaagtagacctctacgcctttgtctttgagctggcggacgtggatgagggtgtcgacggtgttgcgggcgaaccgggacacgctcttggtgaggatcaaatcgatttttccggcgagggtgtcggcgatcatggttttgaagccttcacggtgtttggtgctggtgccagtgatgccttcgtcggcgtacatgcctgcgaattcccactctgtgcgggattggatgtggctcgtgtagtagtcgatttgtgcctcgtaggaggaggcttgttcttccatctcggtggatacccgcgcgtaggccgctaccctgcgccgacgccgagtaccctgcaccgtggtgtgtccgggtatttttgtggctgggatcgcggtgacacgcttgttccgaatctgcttggtggtcatatcgcactttcctcgtccaggctcaccgccactggcacttcgccgctaatggtgtggatggtgagcgtacgatcgggattgacaacgattttcacgaggcgcgtcagcgcatactcgtcgtcccagtcgtcgaggccaagcacgcgggtgcagatctgggtgagatgggtttctcggatttgtggtgcctggcagggattgcctttacctttggtggcggtttcgcaccaccaaaacttgtaggacgtgtggcggcgtgtcttggtgcggcggtgataaaacctgctacagacagagcattcaatccgagaggtgagcccggtcgttctagctgacggcgtggctccacgtccgagatgtctgcgccgggcgagctcggcctggacggcgccgaacgtggtctggtcgatgatgggcgggtgggattcgtcgacgaggtagcgtggcagctcgccggtgttggtatggcagttcaattctgcaacgtttggccggtaatacttttgcaggattacgcggccggtgtagatttcattttcgagccatttgcggatcgtcttaccgcgaaacttggctccccgcctaggcttgaccccttcagcattcaactgactgatgatcttggcttcagtctcgatgatagccaagtcactacccacgtattggtagccgtagggttggcgcgaatgcatgagcccgtcggcgtatttcttccttatcccccatttaacattcttcgacatggatcgagattcctcctgcgcaaacgatgccagcagggtcagcaggagttcaccgtcagcggtcgcggtatcgatctgttcacgctcgaaacgcactgagacgccgaggattttgagttcgcggacggcatcgagcaggtcgacggtgttgcgagtcagcctggatatcgacatcgtcaaaatcatgtcgatgtcgccggagcgggcggcggccatcatggtctggaacccctctcgacggacggtactggtgccggtgatgccttcgtcgatgaacacgcctgcatagtcccaaccaggggtggattgaatcagatgagagtagtacgacacctgggcggcaatcgaagatagctggcgttcgtgctcggtcgatacccgcgcataccctgctactcgtagccgacgtggcgtggcgggtctaggtgggataactcgaaaactacgcgaggtcactccctgcttctctttcttctatggcgacaggtgttttggttgtatccatctacgctctaaacctgagtcttatccagtcgaacctgcagcaacaatgcccccactggcgcggttgcttcatgcccgatccgcgtaaggatcacgtggctttcgtttggggtgagtgcgccggtttcggtgagccgatcaataaaggcgacctggcgggcaagatcgacttcggcattgaacatggcacccgtcacggtctgccacctcgggtgctgaagcggtgcctgatatagcaggcatgcgagcaatacttacggtgcttgtttccgtaggcctcgaagctctcaccgcaagcaacgcaggtgaaggtgtatattgcccgccggttgagccgttcggggtgggcgtgctaccacgacaaacgacacacatccgaacagaacctttgccccgccaccgcagcttcaaaatgcccattacagtgttcgcatgccttagcaggctcaacatcaaccgccggatcgatgttgatgtcagctctgcgacagatcgacttcaccgtattgcgcgacatgcccaatctggtggcgatctgcccatacgatgcgcctcggcatcgcagctccacaactcgctcacgggtaatctcacgtgccatgacgcgctcctgctcaatagaaataaggtctctactgacagggcttcgacccaccccgatttataaccaccactgtcctggtgcgatgggaacaaaaatggccccgccaccacctcatgtagtgaggcagcgacggggcgaaacaggacagttttcatgagtcttggtttagtggcggagtttttcgttgacccggcgctggacggcgtcgtagttggatccgagtctgcgtcggcgttcgttgccgttgccgtattcgccgcggatgaccgcgtcagcgagcgcgtcaatgttcggtgccggcttcggtgtgggtgcgggtttcggtgccggcgcgggtgcgggcgtgttgccggtcatgtggtcgtaccagtactgggcgcgagccatataggcggcgtgctgagtaccggccagcgatgctgggcattcggtggctgagaagtttttgtgcccgaacacgttcttaccccaggtagggcggccgagcttgtaataccgacagatcgcggccaccaaatgtgcgccgttgtcgaggcaggcgtcagagattttccatgggttagaagaggcgtcggcgtgctcgataccaatgctggtggtattggctgcccagtttccggcgtgccaggcggtgtcgcggtcccacacgagctgcccgatccgcccggaggtttctacctggtagtgggcggaggcgggccgggtctgccacac

SEQ ID NO: 98 - DNA, 20723 bp, Propionibacterium acnes
gtgttccagtgcctcgcgggcgtgatgttcttcttcggcaccttcttgccacatgcttcgcgcttcagcctcgccatccaagcgaacctggactgtgaacgagtcctcatcgggtccgtcctcattccacgcggcaatgatcccacgggcctcgtctgcgacctgactcaacttcatcgcctgcccgacagccccgagagccggaatctcgaacacccagatattcgcctcagccgagacctcacgatgggcgatcacttcgtaggtcgtctcaccttctactgtcgtgtccattacttccactccttcggaattttcacgcctgctcgctccagctgtgccaggacaccaactgacgtcagctggtgtcctgctggtatcgatacgcgcccggctccgccggggcgtccccagatttcatggcttcccttggcgttccgcagacgggcccatccttgagaacggagcagcttgaggacgtccttagttttctgcggtttcacacatcatagtatagccccacttaacttgtaaactaagcccctgtttacattttagttggtgcatgtgatccctgctcttatgacgtcgcccgacctggcgccttagacatgcactgttcatcctcaaccacactcaccgtcacgggtccgaaggcgaggtctatcaccattcgcatcgatgaagttgaagcaggatcgtccgcatcacgcactgccgatccggacagacgccaccggccgtaccgactgtttacgatctgccaccgcagactgctgccataaccgctatcacctctgatagtacttttagtactatcagaggtgattcaagattctcctgtcgagcagccctacagtcacgaagtcctgcgatcgtcatcgcttaaggcagacggatggccatcggggaccactcgcaaagcaggggcgatcagcaacagtgatgtgccatgagcaagtactggtgcaccggctgtttactccgcccctagataaaccacgggtgcaggggtggacaccacaccatgaccgatgtggtgcccaccccatggctcacaggcaggccctatcgccgggagcactgctgcagatgaggctcagtaacctgccatgtctcacctggggccaaggtgccaagctccccacggaatctcaggcatcggaaaccagcagccgaacttccacagcatgagcgccctacgaaaaagcaggccgccgacggttctcaagaactcgccggcggcctgcatcgccactcgaactgtaaccgtggtccgaccccgtgcacaggtaagctccacactcccaccaggcatggccgaggcagtaccaagttgccgtggcccatcggcagatttggttaaattttgaaaagtcatatagactccttctgtaaatttttaaatctcataggactctcgccatcgccagccagcttcgacaggagtcccgatgtttcaccgagtgaaatatcggcaccgtttgagttgacctaaagctcaaaagatgctagaatccatcttacctcgttaggggcgttttgtcaaacgcccctatattgcgtgtcttcgcgcgtcgtagcgctgatgctgcgcctgtgtcgactatccgtttgtaagtactttcgatgacaccagcagtggctactcatgactggtgcgtgcgggtctaaagcagcagggaaaggaatcgcagtagaagccgcttgattcctatcacccctgatggtactatcagtactaacagagcagggcttactcgatgcgtgagaatcggggacatgctgagcctctcgtaggtcattggcctgctgggcgtcagtgtggcgcggttcgatccagtgaactctatcagctctgttagtactgtcagagttgatatattcgaccccaggaggagcccatgagttacatcgttcgcaccggaaatttggtcgacacccccgagctgcgtgagggagagcatggccgtacacctacgctcgcgtcatcgtgtccgatcgcattcgccaggaggacggcagctacgtcaacgggccagcgatcgcctacgacgtcttggcgggtggcagccaagccgtgaatctggttgaagccgccaaggcgagcggcaacatccgcatcatgttcgcgggccgttaccgcgtcaccgagtggcggggtgagcagggcactcgtatccagcatgaggtccgagccgacgaggtgagcgtgagcctgctcggtcagagggtgaccgtggagcggcctcgaggtgacgtggcatccaaggagagcacgtcgttctgattgagtccgggggcacggtggtcgccgtggtaaaccgtgcccctgacagtactattgacactattggaggtatcagtgtgactgctcaaattttcgccttgtgcaaccagaagggtggcgtcggaaagtcgacatcgacgtttcatctggcccgtgccgcggtgttgcgtggccagcgtgtgcttgtcgtcgacaacgacccccagggcaacctgacgtctgtcgcggccgccgagcccgtgggggaggatcaggcggggctggccgatgtgctcagcgcgcgtgctccagagaccctccgcgatgtgatcgtgccgggaatctggtctggcctcgatgtcgtgccgacgtctggcatcacgctcggctgggtgcgtgacgaactcgtgatcgccggtgccggccgagaaggccggctgcgggaggccctggccggcgtcgaggacgactacgacgtgatcctgatcgactgtgctccatcgctcgatcagctcacgatcaacggcctggtggccgcccagggtgtcatcgtcgtgacgcactcgaagttgtggagcgccaacggcctcgcccagctgctcgacaccatcgacagcgtgcgcagctactacaacggcgcgctgcgcgtggcgggcatcatcgtcaaccagcacgaggagaacaccatcagcgggaaaacctggctcgacgagctgcatcaggctgccgagtcccggaagctgaccgtgcttgacccgccgatccccaagcgtgtcgtcatcgccgataccgtcgaggccgcgcgcggtctcgacgagtggggaagtgccgaggcggccgcgctcggccagttgtacgcccaccacctgacctgcatcgaaggagccctgtgatgacccgtccagccccccgaaagtcctcattgagcggatcaactccggtcgccccgccggctcagacggcgccggcaccgtctgccgcacctaccccccacaaggccgatgagtcacagacgagcagcaccacgaggaagtggcggcacaaggtgtcgttctaccaggacccggccgacaccgaccgggtgcgcggggcgatcctttacacgatgacgaccgagggcaaccggaacctgagccagttcgtcaacgatgccgtcatggccaaggtggtcgagctggaagtcaagtacaacgatggccagccattccccgctgtgggagcccgaggactaccccagggcggtgcagccgccgccggtgagtagaggaccatcgaccgtcgggggcttcaccatgcccccgaccctcggtcatcctgatcctcttgtcgatggtggtgacagtgggggattcacgcctcgttcagatcagaggaagtctcaccgcgtgattagtactatcaaatctgacagtactaacagagcagatagggttccctaggtcgagctgtatcacgccgacaaccagtgagccagtgatctacggggggcgcaatatgcacccgatcggtagccgcgaaggcctcgccctgccccgatagtactatcaccactatcaatggtgctagtggtgagtttcttccattgatgacaacagcacagtgctgccgtctgtgtgcgggccaccagcccgcacacagttgccgtcgaggacgttgttcatgctctgtggtggccggtcctgagggcggctcgcaggatctcccggcgctcacggcgacgagcctggtagccaaggtctgcatgttcggcggcgagacgggctttgagggttgcggcttctgcacggcggtggagttggtcgtcgatgagttgggcgcgggccagacgccgcttatgggggttgtcgtgggtgaggggggcgtcgaggctgccgtcgtgggttagggccagggctgctcgttcggcgtcgtcgaggccgatgtggtggacggtcacgggtgcggtggtgacgtcgaggatgtccaggtggatgttgtggccgccgccgggggcttcggggaagtctggtgggctggcctggccggtgtcggggtcataccaggacaggccgatgatctcggcccagggtgggggcgggcagacggctcgcagaagggtgtgggccaggaacgtgttgcgggccatgatgcctccaagggtgaaaagcagtcgagtagcgatgacggcggggtagccgtctgctgggctgaggccgaccgggcccatgtcctcgatgctcttgtgctgcggccataccccaaagctaccaaacagtctttttaatctcaaagatacaaacagtgcttgacatattatctgcagcgaaagatactttcatcatggtggctgatcatgattacgcgactcctgacgatgagtggatgacacctcctcaggtggcccgtgtgattccgaacaccactgctcaggctgtccggcgctgggctgaggagggtcagcttcctggggcgtttcgtactccttctgggcgttggcatattccgtggtcggctgtggtgggcatcatggggtttgatccgcgtgagtccgcatcaccgagtgatcgtcaccagagctgacagagtcgtcgatgagctttcgagtgcagagctgatggcacgacggtctggatacttgtggagatgagagacgactacatccagtcatggtcggggtacaccgaggggcagattcagcagtgctggcacgatgaggttgcccctgccattgactcgctcatggagcaggtaaggtctgttgccgagactcctgtgccgccgggttcgagattttacggcgatgagcagtgggccaagccttttcatccgtctactgcgatctgcggttcaatgggtccgccagcgatcacttgcacgcgctgaagctcctcgtctgggaagcgaacgtccaccatgtctatgcgccgtacacccttgctcgtgcatctattgaggcatcgtctactgctgtgtggctgttgagcacgaagacgcgcggagaacgtgtgctgcgagccttgcgatggtacgcgcaggattgtcacgactcgtgcaggttcatggatgatgagcagtatcgtgaccacctattgcggcgcattgaggggactgtcgctgcgggaaatctcgactcgcgcgctgctaggaaacggtaccgtgcaaccgatgttgtcgatgaggctgatcagctggttcccggaactctgagggcgtggcgagctttttctggtatggcccattcccgtatgtgggcatccagggggctgctcgacatggaagtgctgtccagtggccaaggaatggttacggcgaaggtgacgagcggatcggcccaaatcctttgggccgtcgtggcagctctgaatgttgctctcagtgccgctcgcttgtggcgtgattcgatgtgctcaccgtttgctgttgcccagtcggtagacgcgatgccagaggcgtttcgccgccctgtttagggtctgatcggggtagtgggtgttcacggggtcccaggttggccatggggcggcttggtgatgtgagttgggttgtgtggcagcctgggtgttgggtgtggcttcgttggccacgaaggcatgctcttccttgtgctgggacttgagtccccagtgctctcccctttgctagtggggggtggggtccccggaggtaggtcctccggggactttttctatgtctgtccgtgccccaggatttcgtatctaggcagtaccaattttgggttagttggaggtttctttggtaatggacagggtgagggtgatgaagaggtggccgtccttggtggcagaaattttctcgaacttcagctgaatgttgttatcagccactatctgttgggcggtgaggtgctcggagagcttctggaatccttcgcggatccacaggttgtaggggttggtgaccgagaccgaagggtatgggtcgaccttcagcgtcaggactggctggtctgggttgagggagttgatcttcaccagtttggggtaccggtcgcactcatgtgtctcttgtgttgggggccagcagtcgggggcccattcctcccagtggtcacgcatctcacgaagtactttcctgcatctcagcctctgcaggagctcgcgcgccaccgatgggagggctgccatgatgagggcaaggactgcgaacccgatgatgtaattgaccgtgtccctcgtcacgccgttcttgccgaggattccgatggcgaacgcgatgacgacaccgcccaggcacaggtgcatggggtcatgctgtgatggtttttcttcttcagcgactggtggggctatagtcatgtgtgccccttagtactaagtgatactggtgggttgcttttccccggtggccgtgtgcaagacggccaccggggttttccttcatgttcctgattttatctgcccggtgtggcgttttcatctttgtgtgggtggttcgcctggggtcttggagtgtggtgacgcggtgatggtcacggtgacggtgactgtggcgcgtggcgggtgaggtggttctttcctggtctggtgtgtggcccaggtgagtgtggtgatgagggccagggtgaggatgatgaccagggtggggagtagtttgtctggccggtgtcgccgggcttggtggcgcggcatgtttttccagggtgtgtctccgaacaggtcgtcgtcggaggggtcgtcgtggttcatagggtggccttggcgatggtggtgggcgagtttggtccaggtgatggtgccgtcggaggcgatgtggcggtcggcgggcagggtgtggacggtccatccggcgtcggtgagggcggtggtgaaggatttcttgatggatcgtttgggtaggtcgatgggggcgtgggtgccgacccagatgcaccggtttttgaggtgggtggcgccgaggtggttcatgtcgcggaccatgttttgggtgagtgtgagggtgtcggggtcccattggacggggatgatgatgtggtctgcgatggtgatggcgtgttgccaggcggcgtcgaggtcgttgtttccggtgtcgaggatgatgacgtggaagcggcttcttagggcggtgatgatgcggtcgaggtcgtcggcggtggggggtgtgatgaggctgttgtggttgtcggtgatggtgggtaggcatgtgatggtggcccagccttctggttgccaggagatgtaggggtcgaggtcgcggggttgggaggcgaatcctgggtgacgggctgcgcgggcgaggtcgatgacggtgttgtcggtgtggcggggtgcgcgggtggagagggtgccgcgtgggttgatttccacgacgacgatgtcgtcgtgtcctgctgtggtggcgagggcttgggcaaggatgacggccagcggggttttgccggtgccgcctttgaggttggcgagggtgatgatgtggtcggtgagttgggcgggtgcggcggtgtggtgagggttggcggtgaggttggcgatggtgaacagggcatcgagatcgtcggtggtgttctgctcggtgggttgggggtcgccggagatgatcgggtcggcgcggcgcggctgccatgccggcctcaccactgtcacgaccaccacgggtctgctggcgctgtgtgggtgtcgtcggcgatgactcacgatcggcagtctcaccatcgtctcggtgatgctcggctagcgctggacccggtcaagttcgggccggctcacccagtggtgatgactcggtcacagaaccgctgccggtcgttatctcggacgtctcgactcctccagtcctgatgggcgttggagccacctacacctactctcagaacgaccccgacctcgtgtggggcgggggcagatgtcacttgggccaatcgagagcccaggtgatggggaaagcaggggtgtgatatctgtcctggaaaactgggcagctgctaccgtggattgacggatctccacgaaagaagggaatgcgaccatgcagatcaccgtcaagaccatcaaagatcatcgggttcgcactgtccagaccgccatgagcagcgccttggggattggttcccaggtagacatgctcgcccccggcggttccaccagctcgagttccggttcatgctgctcgtgctcgacctgcgcggtagtggcgcagcctcaagactgaacggctggtcagccccaggggcgtggcgctcatcgcgtcacgccccttctattcgctggacagggtgcgcgagctgaggaacatcgcggtgtgtgcgatgacgaggggcaggagcaagtctgtgcgggttgccaagtagccctgcgcgatggccatcacgctggccccgacggcggcgaagacacctccgatacgtcgcttcatgccgccgaattgcatcaggacgaataggactcccgcggtccacatccctccgggcatgcatctgggaaagatgaaccggaagatgatctcttcacaggagagctggagtactagcagcgtagcccccacggggagactcacctctactgacagacggatcgtcttcatccacccacccgagctggcatcgaccatttcggtggccatgcgcgaccggtggcctcgtgcctctcgctgcgtgtcgatccagccgagcagtccgtggacgctctccgctaggactcctgacgcgacagtctcaccaattcctaagcccacggcgaggaccgcgacgcccccctgcacggcaggctgtgtgacttggtggtcccaccaacccgccggcaggaccatgcgtgcgaggctgcacacgagcaggaggtggagggtcacgacgagcgacatctggaataccgcttgccgttcggcgatggtggcgttgggaaagagcggtaggccggcacgggcagcggcgctcgacagcttccgcaagagcggtttggagacgaagtagtaggcgacgtacagcgccagcgctgtcgcgatgatgatcatcggtctgccaccgagctgacccgccgatagccgtttctgttccaccaatactggctgttgtagatcaggtggcccagaacacaggcccagatcccccagaagatgaacaggatagtccccaaggcggcgagcgggatcttggagaggacctgtccccgtccgaacaccgagtggccgcaagcaaacaagagtgctcccacagcggtgagcgcgagccaggccggggttgctcgcagactgatcaccgggaccccgacccggaagccgacctcttctcctacagcgatgactagcaactgccacagcggcatgttctgaacggagcgcgcgactcgggctcgagtcacccacacgggctgttgagcgctcacatcaccactcaggtaccccggtgaggcacttcgcttagtactggggcccgatgtgcgagcattcgtgatgtgtcgcaggatccggttgtcaagccaagaggccagcagggctccggcgacagtgacgggtagcccgatcagcacgaggccccagccatgcggtgccgagaggtttctggccggcgtgcacgcgaggcaggcaagtgccaacactgccagcactacgacgtagatggtcgcataattcgacttgcgggtgacgttgccgaccatcttggccaaagtcgctggggaccagctgatgagtgcgatggtggtcagcaggaagcaggaccagacagacatccggcgcactcaggggtatgggtgcggctgtgggttttggaaaccgccatatgcggcgtagcgggggtgtgcccgcatgggtgcgctgggcagtgacagggcgagcagcccaggcgcccagagcctgacacagtgcagtcccagcccctggatctctatggtggtgaaatcttcgatgtacaggggtgacacacaggtgatgctgttgaccacgctctttaccagttccgcccccgtgtgggtgtcgtcaggtggcaggtcttcggcttgggcaatggtgcccgcgtcgaatttcgccacaactgattgcgcggcctgatagttcctcgcgtagtaggagacgttcgagtcgaggtcaagcatgtcctccgtggacatactggacgcgtcggcctcggcgtcgaaagacgtccataccgcgagcatccgaaccccgctgcactcgagaaacgccttgtacatggctgcttccagacccgcgtctgcacctaggccgacggcgacgaggggaagttggttgccactaccgaccatcatgcatgccacggtgaaatgcttgagcccgggagtcggaagccagtagaaacgcagttcgtggcttcggcccgctgcacgttccacgagccgctggatgcgctggaggcggggtccttcgacgcggatgcgcacaggtgacgaggctccataccacaggcccatcgcggcatctacctggatcaattcataagccgcggacagcgttgcggcgacgcgtgaagtgtggacggcggtgccggtcgtcacggccgttcccagccacggctcaccgtcgtgccgacgggggttgtaacccaggtaaaagaactgcgccgggatccactcctgccgggaggtcccgacacggggagtcttgacccatgtcatgggcaagtcgtcgcgataggtgtcgaacgcacctccagccactcgttgcgcgaagccgaatgcgcccagatcgagaacttcgtcctcggtccgggcgaggagttcctgacgagtcgcccagcgccgttcgaagggactatggagaatcccggtacccgcgcagtagcgctcgacggcctccgcgtagaccttgatctctgcctcaaactcgttcagccccaccccaccgatgtggtagctacccggcttggggtcgggccggtcaagcagtgcgtgcatccccgtgagttccccaccgttcacccgcacgcgggggccgagcgcggggtgcagcgagtagccgacggaagtcaccagcccgcatagcgggctgtaggtgcgccgcctgagccgggctgcggtctcgacggggtcgctatcctggcgaagcttcatcgctcgccccctgccgccagccactcacggatgtcgtagtacaggtccggagcggtttcaacctgcgctggtgcatcaaaacgggacataggtaggacgtcgttgtaggcgatctccatcgtcggtatgtagaccgacaacactttgttgcgcgtcgtgttgaggccgttgcgggcgatgctgacagcctcatgcgcgacgtgcgcggccaagatcgcgcgcaccgacgctgccacggccggcgctccggcccttacgcggtcggcagcggccacccgcatccaggacaggtagctctgccgttcgcgcaggttcatcgcgacccgctgctcgaaggtccggtaggacgaggtcgcaccagggacgacgtagggacccacgtacaaggccggcccgtctacagctgcgtggagccacgacaggtgggcgcgtcgggcgaacaggtcaagggcgcgcagcatagccgggttgttctgcgccagcgctaccacaaggagtggctgcaggtccggcgccgaacccagcaacgccaacatctgggaggcctcctgctccatgtgcaactcgtcggccgactgctcaagccgcaggcctgcgaagagggtggctgatggctgcgtgtcgtcagcgaggacggtagcctgcagcccctctccctcgagaatctgctggatatcgccggcgaggagcgcgtcgtcgctgaatacccacaccgggcgcgtctctctacctccatccatcttgtcctcaacgttttcgaccagcgcaccgatcgatgctaggtgggccatcacgtcgtcaagggccgcgcgggtcaatccgggcacccgggacacgatctcgggcggctgcagtccttggctcaacaagtccaaggccggccacagggtcccggtggcgtcgtcgtcctccagcgttgtgctctcggcgttccagacgcctcgacggaactccaccctgtccatcgagtaaggcaccatcatgaggcccggtgaaatgtggttggtcagtttggctcctgtacagcctaggcttggacgcccacggtcatggtgtgggtcgcggtttggaaaatcccgtcgaggttgagtgcctgattgagttcgtcctcgtagaagcttgaggactcgactgaggcaagaccgagccccgtgcagaccaagttgatctgttgtgcgatcgccccgacttcttgaagggcgaacctcaaacccctggctccgtacttccgcatcgccctccacggcgagatgacgaacaccaagtgcactccggccgcatccgattgctccacggccggctcgccggccatcgaattcctcacgccgcgacagccctcttcaccggtcacgggcaccagtcgatcgatgaccggcgagtagcggtagacgccgcgactcaagccggacacccgttgtgcggacatgaagatagacacgggatacagccctccaccagacgggacagcgcgtacattataccgcacgatatcaccgctcgaacgtgggacatccacgtgccccgtcacaccggcagcacctctcagaaacgcagctacgtcacgcaggtctagggattcgccggtgtagttccgtccgctgcgccggcgggcgatcacttgctcgaggggtgcgcgcaccctgctggacctgggaagttcgatcacatcggcagcgaacgtgtcgcgatccatctgtccgtacgtaacgatcatggggtcaacgaaatagtcgccgaccgagacgttgaactccatatccccccgggcgatgcgcgaggcgagcaagaagtctgcagctgcgttagacagccccggcccatcagtgttgtcgcagcggaactcgtgggtccgaaaccccacaccttccgtgcccgggctctgcgctcgatacgacgtgatcgcagaactagccttccttaaaccgcccggagtagctaccatgaccgtcccctctgaggtctcccgaacacttgcgacaatagcagcatgtgggggcagccgccagaggcgggcatccttgtctcgacaaccattgacctccggattcgatatgtgcataatcatagtcgtgccaacacgaaacgtgtacgtctcggaagacgacctagacctgttcgccgaagccaccgagatcgctggaggcctgtccgcagcggtgttggaggccttgcgcagctacgtagacaggcaccatcgcgcggccggcggattcgacgagatcgagctggagctgcagaacgacggtatcgaccaccgtgtcaccttcatgggtcgccgcctgatacacatccgccgtccagatcccgagggaacccgcatagacactgtctacttgaccgccaaacaccaattcgccgttgccaccaaaatccaacgacggctgccagactggacgaccggccacgagcacatctggtccgacccggagacctggaatcgggagttctggatcgcaggtgacaagacgatggccgtgtatcccagccttgacaaactccgcgaagctgaccccaatgtggccgaacgcgccgaggccgcggtcaaaatcccgccgttcgaggtcctggacatctgatgacagaatcatcatcttcccggcggcaattggcaatgccggtgctgtcagtcacggatctagccaagaaatacgtggttcatggcggctacgaggtcccggcactcaacggtgtctcgtttgacctgcacccgggagagatgctgggtttgttcgggccaaacggtgctggaaagacgacgctggtcaggatcatcgcgggcctcttatcggcagattctggagacgtccactggggatcggatcaaggtcgggccaggttaggctacgtgtcccaaaagggtggactgcagtacgggctcacgtgccgggaagagatggtcttccacgcacaatgcttcggccagtccgccaagcaggcccggactagcgtcgacgaggtcgccgcgatgctgcactgcgattacctgatggagtgggacgtcggaaggctctccggtgggcaacgccgaatcatcgaggtagggctagcactcgtcaatcaaccatcggtcgtcctgctcgacgagcccaccctgggcctggaccccgcaacacgcctgtcgttgtggcaaacggtaaagtcggcacgccgtgagaccggtgctgccttcctcgtcaccacccactacattgacgaggtggccgagcacctgtccaacgtcagcgtgatcaaccacggaaccgtcgtcgccaacggctcgccagcgcacatccgagaaatgttcgcgaccggggaagtaacgctcggcgtggccgaggatacggtggacagtgcggtggacgtgttggctgggaccgcgttcgaggcgcaccccaccgaaaccgtcccggggatcgtggtcaggtccaggcatcccgacgtggacgcggccaagatcatcaccatcctggctggtcatggcatctcggtggactccatatccgtacgcgaggcgaccttggaagaggcgtttctcacgatcacaggcagtcgagacccggagaggcaaatcccatgaacacttgcttcaggcgatatgcggcgatgtcgctgagagcgcggcgtgatttggccctgacattcatccagcccctcgtctacctagccctcttcggaccgctcttcgtcacgacgatgaagatgtcgcagagagctaccgccgctacgggttactccctatacatcacgggcctgtccatccaaatggccatgacgatcggtgccttcgcggggctaaccatcatcctcgaataccgactcggcatcctcgaacggatctggagcacccccctcacggggagcaagatgatggcggggcgaatcgcgcgcgacgtcgttatgatgatgatgccgatactggtcgtcttcatcatcggcctggtgctgggaacacgccccagcccactgggcctggcgacctacttcgtgacagtgctcggcacaggagccacgttcgccggggtctcctacgcggtggcactcagaacgaagagcgaggcagcgctatccgcgatcttcaacctcatcctgctacccgtcctcctgctgtcggggatcatgctgcccatgtcgttcgcaccacactggatcgccaccgctgcccacgtgaacccgttgtggtacctggtgcaaggcgcgcggaaccagttcagcgttctagggctcgtggcggcggccccatggagttgggctgtggccatcgtcatgtcagccgctgccttcggctgggcaagccacgaattcaacaagaggcgctgacacaaagaatggtgccgggaacccaggtccccggcaccaccgagtgcactcgcgacgtcaacgcaccgttgcggtcactgcgcaggtcgagcacgaggacgacgagcccgcgctgctgcaggtcgagccgccaggcgcgagcaggtcgacgttagcgtcggcgccgccgaagacggacgtgacggccggctgagaggtgcggatgcggtgctccagcgaggaggtggtggtgagtttcatgggaggtgctcctaggagtgagacgagaacaaaccctagcgataggttagcagtccgcaaccgactccgggaatagtagaagcgcgcatccgtagcggaagaccttagcctgattacagtgaccctgttcgcgtctcaacattattccacacccccgagcagcgaacgacaccgcgatgatgatccgtcgcctctccaccgaagaactccgcgcccacatcgcaccgggccgccgtcccgtgcatcagacctgccgtcaacgtcggccatgaagctgggaaggtggctctcgtctaggagcagacgcgggacgcctcctccaggttgggccggggaagtgtccggttcttgatgtaggtggcggtccctattgatgggcgttgaccgtgggaatgcggtcggcgaagggggtggcgaacccgttgagcgcaggcttccagcgcatgcatcaacgctgtctgccggccaccggcaagcctcacccgcccgtcatggccatcatcgaggtgccggtgaatcctcgacacatgatcccaactcccccggaggggcttccggggctgttcagccaccagatcagccaggcggcgagcccgactctgccacccggaccctgcagagcgtgcctgctgccgtcgtgtcgtgtcgggccagtgggccaccagatcggccacatccgtcttggcccatctccagcccgccagacccagggaggccatcacctcatcgacgccgcgccgggtggtctcatcaaccccgtcaaacagctcgggccacctcgatgatgccgtccgtgaacgatccagattcatgacatgctcctcttcacagatgccgacgacgatcaggccgtggccgtggcaacggggtgacctgccggcgcggctcacgacgttgagccggaaccacacgagacgcaccagtgtgctgcgccgtcttgagtcgggcgctgtactgggccctggcgctgtggtgaacagcccgacgaagcaccgaccgccggctgtcctcatcgccagggcgaggcatggggcgcggcatggtgcgcccggtagcagcatccatgagggtgatccggtcagccaaaatgccgagccggttttcccacttccggggccacggcaccagcaggtcacgctgacagcccacgccgtggcgtcggcagtccacaacattttctcacggccaggatgcgagtgcagcagctccaccggaacaccagcatcacgcacccgccgcatcgtgacctcatcctcacgtgccaccagcgggggagagcgactaccgctgcagccggtccaaagcgactcttcacagatgagggggtggatcggtagctgacccctaggtcctgatgtgggtcgaggtccttggaatgatggaagttcctacacacccatcgccaaagacctcaacatggacaacgctaccttcaccactccctcatctgtgaagagccagtttatgcacggtgttgaaagaggcgtcggtctacgacgaatgcgggttaatggtcttgcggtgtggggcgctgggcgatggcatcgagaacgcgtgagtgggtggcgatccattcggccgcgtcggggttgatgttgcgggcgacggtgtcgatcgctgttacgtagtgggcaagcctgcgaatctcagcttgttggtcagggtgagcgctgatgaggggctcttgatgggaggcgcggttacggacgtggcggatgagctccacgttttcctcgaagtcgcgtcggctacgccccgggtagtgaggcatacctccgttacgtaagtcagtgagagctttccatacggttgcttccaggcgcggggtgagcagaaagcgccagttgtccagtgacagactcgccacgatctgatcaggggtcgcatcgagcctcgcgcgccgcagtcgcttctcggccctgtcgacgttacgcgggaaaccaccgagccgatagctcggggattcccaccaacgccgtatgccagtatcggcgctcaggcgcacgtcaatgaagtttctcaggagtacctcgacatggctgatgtcttccaagaacgctttcgagatgcgggtgttccacacgtaccacgcatcgactggttcgatccggtagcggctgagcctggcgggtgagaaccactcctgcaacgtctcacgactcaccgtgggagcgtggtaggattgatgacgataggcctcgggaaggtcaatgccgcgaaatatcggtatacccccgaggccattgttttgcccaggcccctcctcgcatacttgcggggcgtcattggctgccgtcatctcgtctcttcccggtacgtggctgtccatgttcacgggcaggtacggcaatgaggttcccgcacacaaacctctaccaagcatacgctggcaagcccccctctcggccccaccacaacatcaattgctgactcgaacacctttgaggcagcgctttcggcttgcgcaaccccatccacgacaccgtccgcttactactcgaagctgagggattcagaccccacctacaccctcgattgtgaagagcctccaaagcccgatacaacgtctggcgagacaccgtgaacgacctcgccaccgcagcaacgcaccagcagcgcgggatggcttggtattagcccagcgcagggccccaggcaccagccctaacgaccccgcacccgacgtggctagaggataagccgcacgggaggactccatacccgccgactcattccagcccgccaccagccgagccatatgatcaaccgcccgcggtaaataatccagccactcacgccggtcgtataaggaaccggccccgctccaggcgtgtgcccaggatcgccacaacacgtcgagctcgaccaccacgcccggaatagattcccactccaaatccggatcagcggccgccacgtaccagatcggccacatccgtcttggcccatctccagcccgccagacccagggaggccatcacctcatcgacgccgcgccgggtggtctcatcaaccccgtcaaacagctcgggccacctcgatgatgccgtccgtgaacgatccagattcatgacatgctcctcttcacagatgccgacgacgatcaggccgtggccgtggcaacggggtgacctgccggcgcggctcacgacgttgagccggaaccacacgagacgcaccagtgtgctgcgccgtcttgagtcgggcgctgtactgggccctggcgctgtggtgaacagcccgacgaagcaccgaccgccggctgtcctcatcgccagggcgaggcatggggcgcggcatggtgcgcccggtagcagcatccatgagggtgatccggtcagccaaaatgccgagccggttttcccacttccggggccacggcaccagcaggtcacgctgacagcccacgccgtggcgtcggcagtccacaacattttctcacggccaggatgcgagtgcagcagctccaccggaacaccagcatcacgcacccgccgcatcgtgacctcatcctcacgctgccgatcaccgtcaaccagatggtcagccacgatggtgttcacaccccatgactcatgcagttgcctggccaaggcgcccaacacctgctgacgcacctgtgacttgacgtcatcatcctccagatcctgtgtaccaaccatcacggaggccaacacatcactgcgttgctgaaccagggtgttgacgacgtcgacatcgtcgatacccatgggattgttggcgcgcgcggccacggcatgaaacgtgttggactgcaaattctcgaccagaccacgccgatagtcgttgaactgggaggtgtcggcaatgacaccggtcatgatgtaggccgacccctcggacaaggccctgtaggactcgtcgacgaacgccaccaaccccggccgccgccggtaaagtcgacctgcttcctcgtcagccagcaaccatgacagtttttgccccatatgtcctccttgctgacatgacctcgaacatggtaaactttccgtaggaaaaacggggcaagtactttcgagcggctacctcggcccccggtggaatgtccagccttgtgcggaccgaagccgggggattccttatgtttgcggcaatgatgccgctgcaccccctcatgccgtggtgtggtcctttccccgtgtgcggtgtggtgcgtcgttgactggtttgtggccccgagccttactctgaccggtaggagaacggtgtggggtctacggatagcccactcggctcccggtggaatgtccaacagggtagggttgatgagttggtccatcaggaccgtcccggtggctgcgtcaatgatcgatatttcgatgatgcgcccgtccaggtcggtggtttcggtgtcgaggatgactccgactccgggttctaggagttggggatccaatgggtggtcatcgtgtggctcctacagggagtgtctgggctggacagcggtgcaatacccgcgccatagcggttttttctgcgggggtgacccacagctggtatttcgttttgacggcgatttggcgggccacgtagtcgcatctgtaggccttgttagggggtagccaggtcgctgcatccctgtctcgtttggcctcattagcgggtccgtcgacagccagcaagttcaacgggtcgttggccagggcggtgcgttgcagcggtgagagtttttgcgcgccggtaatccacgcgttcccgagggctacgacgtggtcgatttggactgttgtcgaggtgtgccggccgcgccgccaggcgagtgtggacccggtgtaggggtcgtggagtcgcccggagacgaccacgcatcgtgatccgggtttcaggtgggcctcgaccaggtcgcgggcaagggcatcgttgcgggtgtcgcatccgttgtggccccaggggcgggtcaa

SEQ ID NO: 99 - DNA, 17173 bp, Propionibacterium acnes
gtgttccagtgcctcgcgggcgtgatgttcttcttcggcaccttcttgccacatgcttcgcgcttcagcctcgccatccaagcgaacctggactgtgaacgagtcctcatcgggtccgtcctcattccacgcggcaatgatcccacgggcctcgtctgcgacctgactcaacttcatcgcctgcccgacagccccgagagccggaatctcgaacacccagatattcgcctcagccgagacctcacgatgggcgatcacttcgtaggtcgtctcaccttctactgtcgtgtccattacttccactccttcggaattttcacgcctgctcgctccagctgtgccaggacaccaactgacgtcagctggtgtcctgctggtatcgatacgcgcccggctccgccggggcgtccccagatttcatggcttcccttggcgttccgcagacgggcccatccttgagaacggagcagcttgaggacgtccttagttttctgcggtttcacacatcatagtatagccccacttaacttgtaaactaagcccctgtttacattttagttggtgcatgtgatccctgctcttatgacgtcgcccgacctggcgccttagacatgcactgttcatcctcaaccacactcaccgtcacgggtccgaaggcgaggtctatcaccattcgcatcgatgaagttgaagcaggatcgtccgcatcacgcactgccgatccggacagacgccaccggccgtaccgactgtttacgatctgccaccgcagactgctgccataaccgctatcacctctgatagtacgtttagtactatcagaggtgattcaagattctcctgtcgagcagccctacagtcacgaagtcctgcgatcgtcatcgcttaaggcagacggatggccatcggggaccactcgcaaagcaggggcgatcagcaacagtgatgtgccatgagcaagtactggtgcaccggctgtttactccgcccctagataaaccacgggtgcaggggtggacaccacaccatgaccgatgtggtgcccaccccatggctcacaggcaggccctatcgccgggagcactgctgcagatgaggctcagtaacctgccatgtctcacctggggccaaggtgccaagctccccacggaatctcaggcatcggaaaccagcagccgaacttccacagcatgagcgccctacgaaaaagcaggccgccgacggttctcaagaactcgccggcggcctgcatcgccactcgaactgtaaccgtggtccgaccccgtgcacaggtaagctccacactcccaccaggcatggccgaggcagtaccaagttgccgtggcccatcggcagatttggttaaattttgaaaagtcatatagactccttctgtaaatttttaaatctcataggactctcgccatcgccagccagcttcgacaggagtcccgatgtttcaccgagtgaaatatcggcaccgtttgagttgacctaaagctcaaaagatgctagaatccatcttacctcgttaggggcgttttgtcaaacgcccctatattgcgtgtcttcgcgcgtcgtagcgctgatgctgcgcctgtgtcgactatccgtttgtaagtactttcgatgacaccagcagtggctactcatgactggtgcgtgcgggtctaaagcagcagggaaaggaatcgcagtagaagccgcttgattcctatcacccctgatggtactatcagtactaacagagcagggcttactcgatgcgtgagaatcggggacatgctgagcctctcgtaggtcattggcctgctgggcgtcagtgtggcgcggttcgatccagtgaactctatcagctctgttagtactgtcagagttgatatattcgaccccaggaggagcccatgagttacatcgttcgcaccggaaatttggtcgacacccccgagctgcgtgagggagagcatggcccgtacacctacgctcgcgtcatcgtgtccgatcgcattcgccaggaggacggcagctacgtcaacgggccagcgatcgcctacgacgtcttggcgggtggcagccaagccgtgaatctggttgaagccgccaaggcgagcggcaacatccgcatcatgttcgcgggccgttaccgcgtcaccgagtggcggggtgagcagggcactcgtatccagcatgaggtccgagccgacgaagtgagcgtgagcctgctcggtcagagggtgaccgtggagcggcctcgaggtgacgtggcatccaaggagagcacgtcgttctgattgagtccgggggcacggtggtcgccgtggtaaaccgtgcccctgacagtactattgacactattggaggtatcagtgtgactgctcaaattttcgccttgtgcaaccagaagggtggcgtcggaaagtcgacatcgacgtttcatctggcccgtgccgcggtgttgcgtggccagcgtgtgcttgtcgtcgacaacgacccccagggcaacctgacgtctgtcgcggccgccgagcccgtgggggaggatcaggcggggctggccgatgtgctcagcgcgcgtgctccagagaccctccgcgatgtgatcgtgccgggaatctggtctggcctcgatgtcgtgccgacgtctggcatcacgctcggctgggtgcgtgacgaactcgtgatcgccggtgccggccgagaaggccggctgcgggaggccctggccggcgtcgaggacgactacgacgtgatcctgatcgactgtgctccatcgctcgatcagctcacgatcaacggcctggtggccgcccagggtgtcatcgtcgtgacgcactcgaagttgtggagcgccaacggcctcgcccagctgctcgacaccatcgacagcgtgcgcagctactacaacggcgcgctgcgcgtggcgggcatcatcgtcaaccagcacgaggagaacaccatcagcgggaaaacctggctcgacgagctgcatcaggctgccgagtcccggaagctgaccgtgcttgacccgccgatccccaagcgtgtcgtcatcgccgataccgtcgaggccgcgcgcggtctcgacgagtggggaagtgccgaggcggccgcgctcggccagttgtacgcccaccacctgacctgcatcgaaggagccctgtgatgacccgtccagccccccgaaagtcctcattgagcggatcaactccggtcgccccgccggctcagacggcgccggcaccgtctgccgcacctaccccccacaaggccgatgagtcacagacgagcagcaccacgaggaagtggcggcacaaggtgtcgttctaccaggacccggccgacaccgaccgggtgcgcggggcgatcctttacacgatgacgaccgagggcaaccggaacctgagccagttcgtcaacgatgccgtcatggccaaggtggtcgagctggaagtcaagtacaacgatggccagccattccccgctgtgggagcccgaggactaccccagggcggtgcagccgccgccggtgagtagaggaccatcgaccgtcgggggcttcaccatgcccccgaccctcggtcatcctgatcctcttgtcgatggtggtgacagtgggggattcacgcctcgttcagatcagaggaagtctcaccgcgtgattagtactatcaaatctgacagtactaacagagcagatagggttccctaggtcgagctgtatcacgccgacaaccagtgagccagtgatctacgaggggcgcaatatgcacccgatcggtagccgcgaaggcctcgccctgccccgatagtactatcaccactatcaatggtgctagtggtgagtttcttccattgatgacaacagcacagtgctgccgtctgtgtgcgggccaccagcccgcacacagttgccgtcgaggacgttgttcatgctctgtggtggccggtcctgagggcggctcgcaggatctcccggcgctcacggcgacgagcctggtagccaaggtctgcatgttcggcggcgagacgggctttgagggttgcggcttctgcacggcggtggagttggtcgtcgatgagttgggcgcgggccagacgccgcttatgggggttgtcgtgggtgaggggggcgtcgaggctgccgtcgtgggttagggccagggctgctcgttcggcgtcgtcgaggccgatgtggtggacggtcacgggtgcggtggtgacgtcgaggatgtccaggtggatgttgtggccgccgccgggggcttcggggaagtctggtgggctggcctggccggtgtcggggtcataccaggacaggccgatgatctcggcccagggtgggggcgggcagacggctcgcagaagggtgtgggccaggaacgtgttgcgggccatgatgcctccaagggtgaaaagcagtcgagtagcgatgacggcggggtagccgtctgctgggctgaggccgaccgggcccatgtcctcgatgctcttgtgctgcggccataccccaaagctaccaaacagtctttttaatctcaaagatacaaacagtgcttgacatattatctgcagcgaaagatactttcatcatggtggctgatcatgattacgcgactcctgacgatgagtggatgacacctcctcaggtggcccgtgtgattccgaacaccactgctcaggctgtccggcgctgggctgaggagggtcagcttcctggggcgtttcgtactccttctgggcgttggcatattccgtggtcggctgtggtgggcatcatggggtttgatccgcgtgagtccgcatcaccgagtgatcgtcaccagagctgacagagtcgtcgatgagctttcgagtgcagagctgatggcacgacggtctggatacttgtggagatgagagacgaccacatccagtcatggtcggggtacaccgaggggcagattcagcagtgctggcacgatgaggttgcccctgccattgactcgctcatggagcaggtaaggtctgttgccgagactcctgtgccgccgggttcgagattttacggcgatgagcagtgggccaagccttttcatccgtctactgcgatctgcggttcaatgggtccgccagcgatcacttgcacgcgctgaagctcctcgtctgggaagcgaacgtccaccatgtctatgcgccgtacacccttgctcgtgcatctattgaggcatcgtctactgctgtgtggctgttgagcacgaagacgcgcggagaacgtgtgctgcgagccttgcgatggtacgcgcaggattgtcacgactcgtgcaggttcatggatgatgagcagtatcgtgaccacctattgcggcgcattgaggggactgtcgctgcgggaaatctcgactcgcgcgctgctaggaaacggtaccgtgcaaccgatgttgtcgatgaggctgatcagctggttcccggaactctgagggcgtggcgagctttttctggtatggcccattcccgtatgtgggcatccagggggctgctcgacatggaagtgctgtccagtggccaaggaatggttacggcgaaggtgacgagcggatcggcccaaatcctttgggccgtcgtggcagctctgaatgttgctctcagtgccgctcgcttgtggcgtgattcgatgtgctcaccgtttgctgttgcccagtcggtagacgcgatgccagaggcgtttcgccgccctgtttagggtctgatcggggtagtgggtgttcacggggtcccaggttggccatggggcggcttggtgatgtgagttgggttgtgtggcagcctgggtgttgggtgtggcttcgttggccacgaaggcatgctcttccttgtgctgggacttgagtccccagtgctctcccctttgctagtggggggtggggtccccggaggtaggtcctccggggactttttctatgtctgtccgtgccccaggatttcgtatctaggcagtaccaattttgggttagttggaggtttctttggtaatggacagggtgagggtgatgaagaggtggccgtccttggtggcagaaattttctcgaacttcagctgaatgttgttatcagccactatctgttgggcggtgaggtgctcggagagcttctggaatccttcgcggatccacaggttgtaggggttggtgaccgagaccgaagggtatgggtcgaccttcagcgtcaggactggctggtctgggttgagggagttgatcttcaccagtttggggtaccggtcgcactcatgtgtctcttgtgttgggggccagcagtcgggggcccattcctcccagtggtcacgcatctcacgaagtactttcctgcatctcagcctctgcaggagctcgcgcgccaccgatgggagggctgccatgatgagggcaaggactgcgaacccgatgatgtaattgaccgtgtccctcgtcacgccgttcttgccgaggattccgatggcgaacgcgatgacgacaccgcccaggcacaggtgcatggggtcatgctgtgatggtttttcttcttcagcgactggtggggctatagtcatgtgtgccccttagtactaagtgatactggtgggttgcttttccccggtggccgtgtgcaagacggccaccggggttttccttcatgttcctgattttatctgcccggtgtggcgttttcatctttgtgtgggtggttcgcctggggtcttggagtgtggtgacgcggtgatggtcacggtgacggtgactgtggcgcgtggcgggtgaggtggttctttcctggtctggtgtgtggcccaggtgagtgtggtgatgagggccagggtgaggatgatgaccagggtggggagtagtttgtctggccggtgtcgccgggcttggtggcgcggcatgtttttccagggtgtgtctccgaacaggtcgtcgtcggaggggtcgtcgtggttcatagggtggccttggcgatggtggtgggcgagtttggtccaggtgatggtgccgtcggaggcgatgtggcggtcggcgggcagggtgtggacggtccatccggcgtcggtgagggcggtggtgaaggatttcttgatggatcgtttgggtaggtcgatgggggcgtgggtgccgacccagatgcaccggtttttgaggtgggtggcgccgaggtggttcatgtcgcggaccatgttttgggtgagtgtgagggtgtcggggtcccattggacggggatgatgatgtggtctgcgatggtgatggcgtgttgccaggcggcgtcgaggtcgttgtttccggtgtcgaggatgatgacgtggaagcggcttcttagggcggtgatgatgcggtcgaggtcgtcggcggtggggggtgtgatgaggctgttgtggttgtcggtgatggtgggtaggcatgtgatggtggcccagccttctggttgccaggagatgtaggggccgaggtcgcggggttgggaggcgaatcctgggtgacgggctgcgcgggcgaggtcgatgacggtgttgtcggtgtggcggggtgcgcgggtggagagggtgccgcgtgggttgatttccacgacgacgatgtcgtcgtgtcctgctgtggtggcgagggcttgggcaaggatgacggccagcggggttttgccggtgccgcctttgaggttggcgagggtgatgatgtggtcggtgagttgggcgggtgcggcggtgtggtgagggttggcggtgaggttggcgatggtgaacagggcatcgagatcgtcggtggtgttctgctcggtgggttgggggtcgccggagatgatcgggtcggcgcggcgcggctgccatgccggcctcaccactgtcacgaccaccacgggtctgctggcgctgtgtgggtgtcgtcggcgatgactcacgatcggcagtctcaccatcgtctcggtgatgctcggctagcgctggacccggtcaagttcgggccggctcacccagtggtgatgactcggtcacagaaccgctgccggtcgttatctcggacgtctcgactcctccagtcctgatgggcgttggagccacctacacctactctcagaacgaccccgacctcgtgtggggcgggggcagatgtcacttgggccaatcgagagcccaggtgatggggaaagcaggggtgtgatatctgtcctggaaaactgggcagctgctaccgtggattgacggatctccacgaaagaagggaatgcgaccatgcagatcaccgtcaagaccatcaaagatcatcgggttcgcactgtccagaccgccatgagcagcgccttggggattggttcccaggtagacatgctcgcccccggcggttccaccagctcgagttccggttcatgctgctcgtgctcgacctgcgcggtagtggcgcagcctcaagactgaacggctggtcagccccaggggcgtggcgctcatcgcgtcacgccccttctattcgctggacagggtgcgcgagctgaggaacatcgcggtgtgtgcgatgacgaggggcaggagcaagtctgtgcgggttgccaagtagccctgcgcgatggccatcacgctggccccgacggcggcgaagacacctccgatacgtcgcttcatgccgccgaattgcatcaggacgaataggactcccgcggtccacatccctccgggcatgcatctgggaaagatgaaccggaagatgatctcttcacaggagagctggagtactagcagcgtagcccccacggggagactcacctctactgacagacggatcgtcttcatccacccacccgagctggcatcgaccatttcggtggccatgcgcgaccggtggcctcgtgcctctcgctgcgtgtcgatccagccgagcagtccgtggacgctctccgctaggactcctgacgcgacagtctcaccaattcctaagcccacggcgaggaccgcgacgcccccctgcacggcaggctgtgtgacttggtggtcccaccaacccgccggcaggaccatgcgtgcgaggctgcacacgagcaggaggtggagggtcacgacgagcgacatctggaataccgcttgccgttcggcgatggtggcgttgggaaagagcggtaggccggcacgggcagcggcgctcgacagcttccgcaagagcggtttggagacgaagtagtaggcgacgtacagcgccagcgctgtcgcgatgatgatcatcggtctgccaccgagctgacccgccgatagccgtttctgttccaccaatactggctgttgtagatcaggtggcccagaacacaggcccagatcccccagaagatgaacaggatagtccccaaggcggcgagcgggatcttggagaggacctgtccccgtccgaacaccgagtggccgcaagcaaacaagagtgctcccacagcggtgagcgcgagccaggccggggttgctcgcagactgatcaccgggaccccgacccggaagccgacctcttctcctacagcgatgactagcaactgccacagcggcatgttctgaacggagcgcgcgactcgggctcgagtcacccacacgggctgttgagcgctcacatcaccactcaggtaccccggtgaggcacttcgcttagtactggggcccgatgtgcgagcattcgtgatgtgtcgcaggatccggttgtcaagccaagaggccagcagggctccggcgacagtgacgggtagcccgatcagcacgaggccccagccatgcggtgccgagaggtttctggccggcgtgcacgcgaggcaggcaaatgccatcactgccagcactacgacgtagatggtcgcataattcgacttgcgggtgacgttgccgaccatcttggccaaagtcgctggggaccagctgatgagtgcgatggtggtcagcaggaagcaggaccagacagacatccggcgcactcaggggtatgggtgcggctgtgggttttggaaaccgccatatgcggcgtagcgggggtgtgcccgcatgggtgcgctgggcagtgacagggcgagcagcccaggcgcccagagcctgacacagtgcagtcccagcccctggatctctatggtggtgaaatcttcgatgtacaggggtgacacacaggtgatgctgttgaccacgctctttaccagttccgcccccgtgtgggtgtcgtcaggtggcaggtcttcggcttgggcaatggtgcccgcgtcgaatttcgccacaactgattgcgcggcctgatagttcctcgcgtagtaggagacgttcgagtcgaggtcaagcatgtcctccgtggacatactggacgcgtcggcctcggcgtcgaaagacgtccataccgcgagcatccgaaccccgctgcactcgagaaacgccttgtacatggctgcttccagacccgcgtctgcacctaggccgacggcgacgaggggaagttggttgccactaccgaccatcatgcatgccacggtgaaatgcttgagcccgggagtcggaagccagtagaaacgcagttcgtggcttcggcccgctgcacgttccacgagccgctggatgcgctggaggcggggtccttcgacgcggatgcgcacaggtgacgaggctccataccacaggcccatcgcggcatctacctggatcaattcataagccgcggacagcgttgcggcgacgcgtgaagtgtggacggcggtgccggtcgtcacggccgttcccagccacggctcaccgtcgtgccgacgggggttgtaacccaggtaaaagaactgcgccgggatccactcctgccgggaggtcccgacacggggagtcttgacccatgtcatgggcaagtcgtcgcgataggtgtcgaacgcacctccagccactcgttgcgcgaagccgaatgcgcccagatcgagaacttcgtcctcggtccgggcgaggagttcctgacgagtcgcccagcgccgttcgaagggactatggagaatcccggtacccgcgcagtagcgctcgacggcctccgcgtagaccttgatctctgcctcaaactcgttcagccccaccccaccgatgtggtagctacccggcttggggtcgggccggtcaagcagtgcgtgcatccccgtgagttccccaccgttcacccgcacgcgggggccgagcgcggggtgcagcgagtagccgacggaagtcaccagcccgcatagcgggctgtaggtgcgccgcctgagccgggctgcggtctcgacggggtcgctatcctggcgaagcttcatcgctcgccccctgccgccagccactcacggatgtcgtagtacaggtccggagcggtttcaacctgcgctggtgcatcaaaacgggacataggtaggacgtcgttgtaggcgatctccatcgtcggtatgtagaccgacaacactttgttgcgcgtcgtgttgaggccgttgcgggcgatgctgacagcctcatgcgcgacgtgcgcggccaagatcgcgcgcaccgacgctgccacggccggcgctccggcccttacgcggtcggcagcggccacccgcatccaggacaggtagctctgccgttcgcgcaggttcatcgcgacccgctgctcgaaggtccggtaggacgaggtcgcaccagggacgacgtagggacccacgtacaaggccggcccgtctacagctgcgtggagccacgacaggtgggcgcgtcgggcgaacaggtcaagggcgcgcagcatagccgggttgttctgcgccagcgctaccacaaggagtggctgcaggtccggcgccgaacccagcaacgccaacatctgggaggcctcctgctccatgtgcaactcgtcggccgactgctcaagccgcaggcctgcgaagagggtggctgatggctgcgtgtcgtcagcgaggacggtagcctgcagcccctctccctcgagaatctgctggatatcgccggcgaggagcgcgtcgtcgctgaatacccacaccgggcgcgtctctctacctccatccatcttgtcctcaacgttttcgaccagcgcaccgatcgatgctaggtgggccatcacgtcgtcaagggccgcgcgggtcaatccgggcacccgggacacgatctcgggcggctgcagtccttggctcaacaagtccaaggccggccacagggtcccggtggcgtcgtcgtcctccagcgttgtgctctcggcgttccagacgcctcgacggaactccaccctgtccatcgagtaaggcaccatcatgaggcccggtgaaatgtggttggtcactttggctcctgtacagcctaggcttggacgcccacggtcatggtgtgggtcgcggtttggaaaatcccgtcgaggttgagtgcctgattgagttcgtcctcgtagaagcttgaggactcgactgaggcaagaccgagccccgtgcagaccaagttgatctgttgtgcgatcgccccgacttcttgaagggcgaacctcaaacccctggctccgtacttccgcatcgccctccacggcgagatgacgaacaccaagtgcactccggccgcatccgattgctccacggccggctcgccggccatcgaattcctcacgccgcgacagccctcttcaccggtcacgggcaccagtcgatcgatgaccggcgagtagcggtagacgccgcgactcaagccggacacccgttgtgcggacatgaagatagacacgggatacagccctccaccagacgggacagcgcgtacattataccgcacgatatcaccgctcgaacgtgggacatccacgtgccccgtcacaccggcagcacctctcagaaacgcagctacgtcacgcaggtctagggattcgccggtgtagttccgtccgctgcgccggcgggcgatcacttgctcgaggggtgcgcgcaccctgctggacctgggaagttcgatcacatcggcagcgaacgtgtcgcgatccatctgtccgtacgtaacgatcatggggtcaacgaaatagtcgccgaccgagacgttgaactccatatccccccgggcgatgcgcgaggcgagcaagaagtctgcagctgcgttagacagccccggcccatcagtgttgtcgcagcggaactcgtgggtccgaaaccccacaccttccgtgcccgggctctgcgctcgatacgacgtgatcgcagaactagccttccttaaaccgcccggagtagctaccatgaccgtcccctctgaggtctcccgaacacttgcgacaatagcagcatgtgggggcagccgccagaggcgggcatccttgtctcgacaaccattgacctccggattcgatatgtgcataatcatagtcgtgccaacacgaaacgtgtacgtctcggaagacgacctagacctgttcgccgaagccaccgagatcgctggaggcctgtccgcagcggtgttggaggccttgcgcagctacgtagacaggcaccatcgcgcggccggcggattcgacgagatcgagctggagctgcagaacgacggtatcgaccaccgtgtcaccttcatgggtcgccgcctgatacacatccgccgtccagatcccgagggaacccgcatagacactgtctacttgaccgccaaacaccaattcgccgttgccaccaaaatccaacgacggctgccagactggacggccggccacgagcacatctggtccgacccggagacctggaatcgggagttctggatcgcaggtgacaagacgatggccgtgtatcccagccttgacaaactccgcgaagctgaccccaatgtggccgaacgcgccgaggccgcggtcaaaatcccgccgttcgaggtcctggacatctgatgacagaatcatcatcttcccggcggcaattggcaatgccggtgctgtcagtcacggatctagccaagaaatacgtggttcatggcggctacgaggtcccggcactcaacggtgtctcgtttgacctgcacccgggagagatgctgggtttgttcgggccaaacggtgctggaaagacgacgctggtcaggatcatcgcgggcctcttatcggcagattctggagacgtccactggggatcggatcaaggtcgggccaggttaggctacgtgtcccaaaagggtggactgcagtacgggctcacgtgccgggaagagatggtcttccacgcacaatgcttcggccagtccgccaagcaggcccggactagcgtcgacgaggtcgccgcgatgctgcactgcgattacctgatggagtgggacgtcggaaggctctccggtgggcaacgccgaatcatcgaggtagggctagcactcgtcaatcaaccatcggtcgtcctgctcgacgagcccaccctgggcctggaccccgcaacacgcctgtcgttgtggcaaacggtaaagtcggcacgccgtgagaccggtgctgccttcctcgtcaccacccactacattgacgaggtggccgagcacctgtccaacgtcagcgtgatcaaccacggaaccgtcgtcgccaacggctcgccagcgcacatccgagaaatgttcgcgaccggggaagtaacgctcggcgtggccgaggatacggtggacagtgcggtggacgtgttggctgggaccgcgttcgaggcgcaccccaccgaaaccgtcccggggatcgtggtcaggtccaggcatcccgacgtggacgcggccaagatcatcaccatcctggctggtcatggcatctcggtggactccatatccgtacgcgaggcgaccttggaagaggcgtttctcacgatcacaggcagtcgagacccggagaggcaaatcccatgaacacttgcttcaggcgatatgcggcgatgtcgctgagagcgcggcgtgatttggccctgacattcatccagcccctcgtctacctagccctcttcggaccgctcttcgtcacgacgatgaagatgtcgcagagagctaccgccgctacgggttactccctatacatcacgggcctgtccatccaaatggccatgacgatcggtgccttcgcggggctaaccatcatcctcgaataccgactcggcatcctcgaacggatctggagcacccccctcacggggagcaagatgatggcggggcgaatcgcgcgcgacgtcgttatgatgatgatgccgatactggtcgtcttcatcatcggcctggtgctgggaacacgccccagcccactgggcctggcgacctacttcgtgacagtgctcggcacaggagccacgttcgccggggtctcctacgcggtggcactcagaacgaagagcgaggcagcgctatccgcgatcttcaacctcatcctgctacccatcctcctgctgtcggggatcatgctgcccatgtcgttcgcaccacactggatcgccaccgctgcccacgtgaacccgttgtggtacctggtgcaaggcgcgcggaaccagttcagcgttctagggctcgtggcggcggccccatggagttgggctgtggccatcgtcatgtcagccgctgccttcggctgggcaagccacgaattcaacaagaggcgctgacacaaagaatggtgccgggaacccaggtccccggcaccaccgagtgcactcgcgacgtcaacgcaccgttgcggtcactgcgcaggtcgagcacgaggacgacgagcccgcgctgctgcaggtcgagccgccaggcgcgagcaggtcgacgttagcgtcggcgccgccgaagacggacgtgacggccggctgagaggtgcggatgcggtgctccagcgaggaggtggtggtgagtttcatgggaggtgctcctaggagtgagacgagaacaaaccctagcgataggttagcagtccgcaaccgactccgggaatagtagaagcgcgcatccgtagcggaagaccttagcctgattacagtgaccctgttcgcgtctcaacattattccacacccccgagcagcgaacgacaccgcgatgatgatccgtcgcctctccaccgaagaactccgcgcccacatcgcaccgggccgccgtcccgtgcatcagacctgccgtcaacgtcggccatgaagctgggaaggtggctctcgtctaggagcagacgcgggacgcctcctccaggttgggccggggaagtgtccggttcttgatgtaggtggcggtccctattgatgggcgttgaccgtgggaatgcggtcggcgaagggggtggcgaacccgttgagcgcaggcttccagcgcatgcatcaacgctgtctgccggccaccggcaagcctcacccgcccgtcatggccatcatcgaggtgccggtgaatcctcgacacatgatcccaactcccccggaggggcttccggggctgttcagccaccagatcagccaggcggcgagcccgactctgccacccggaccctgcagagcgtgcctgctgccgtcgtgtcgtgtcgggccagtgggccaccagatcggccacatccgtcttggcccatctccagcccgccagacccagggaggccatcacctcatcgacgccgcgccgggtggtctcatcaaccccgtcaaacagctcgggccacctcgatgatgccgtccgtgaacgatccagattcatgacatgctcctcttcacagatgccgacgacgatcaggccgtggccgtggcaacggggtgacctgccggcgcggctcacgacgttgagccggaaccacacgagacgcaccagtgtgctgcgccgtcttgagtcgggcgctgtactgggccctggcgctgtggtgaacagcccgacgaagcaccgaccgccggctgtcctcatcgccagggcgaggcatggggcgcggcatggtgcgcccggtagcagcatccatgagggtgatccggtcagccaaaatgccgagccggttttcccacttccggggccacggcaccagcaggtcacgctgacagcccacgccgtggcgtcggcagtccacaacattttctcacggccaggatgcgagtgcagcagctccaccggaacaccagcatcacgcacccgccgcatcgtgacctcatcctcacgtgccaccagcgggggagagcgactaccgctgcagccggtccaaagcgactcttcacagatgagggggtggatcggtagctgacccctaggtcctgatgtgggtcgaggtcct

SEQ ID NO: 100 - DNA, 599 bp, Propionibacterium acnes
accagatcggccacatccgtcttggcccatctccagcccgccagacccagggaggccatcacctcatcgacgccgcgccgggtggtctcatcaaccccgtcaaacagctcgggccacctcgatgatgccgtccgtgaacgatccagattcatgacatgctcctcttcacagatgccgacgacgatcaggccgtggccgtggcaacggggtgacctgccggcgcggctcacgacgttgagccggaaccacacgagacgcaccagtgtgctgcgccgtcttgagtcgggcgctgtactgggccctggcgctgtggtgaacagcccgacgaagcaccgaccgccggctgtcctcatcgccagggcgaggcatggggcgcggcatggtgcgcccggtagcagcatccatgagggtgatccggtcagccaaaatgccgagccggttttcccacttccggggccacggcaccagcaggtcacgctgacagcccacgccgtggcgtcggcagtccacaacattttctcacggccaggatgcgagtgcagcagctccaccggaacaccagcatcacgcacccgccgcatcgtgacctcatcctcacg

SEQ ID NO: 101 - DNA, 17175 bp, Propionibacterium acnes
gtgttccagtgcctcgcgggcgtgatgttcttcttcggcaccttcttgccacatgcttcgcgcttcagcctcgccatccaagcgaacctggactgtgaacgagtcctcatcgggtccgtcctcattccacgcggcaatgatcccacgggcctcgtctgcgacctgactcaacttcatcgcctgcccgacagccccgagagccggaatctcgaacacccagatattcgcctcagccgagacctcacgatgggcgatcacttcgtaggtcgtctcaccttctactgtcgtgtccattacttccactccttcggaattttcacgcctgctcgctccagctgtgccaggacaccaactgacgtcagctggtgtcctgctggtatcgatacgcgcccggctccgccggggcgtccccagatttcatggcttcccttggcgttccgcagacgggcccatccttgagaacggagcagcttgaggacgtccttagttttctgcggtttcacacatcatagtatagccccacttaacttgtaaactaagcccctgtttacattttagttggtgcatgtgatccctgctcttatgacgtcgcccgacctggcgccttagacatgcactgttcatcctcaaccacactcaccgtcacgggtccgaaggcgaggtctatcaccattcgcatcgatgaagttgaagcaggatcgtccgcatcacgcactgccgatccggacagacgccaccggccgtaccgactgtttacgatctgccaccgcaggctgctgccataaccgctatcacctctgatagtacttttagtactatcagaggtgattcaagattctcctgtcgagcagccctacagtcacgaagtcctgcgatcgtcatcgcttaaggcagacggatggccatcggggaccactcgcaaagcaggggcgatcagcaacagtgatgtgccatgagcaagtactggtgcaccggctgtttactccgcccctagataaaccacgggtgcaggggtggacaccacaccatgaccgatgtggtgcccaccccatggctcacaggcaggccctatcgccgggagcactgctgcagatgaggctcagtaacctgccatgtctcacctggggccaaggtgccaagctccccacggaatctcaggcatcggaaaccagcagccgaacttccacagcatgagcgccctacgaaaaagcaggccgccgacggttctcaagaactcgccggcggcctgcatcgcaactcgaactgtaaccgtggtccgaccccgtgcacaggtaagctccacactcccaccaggcatggccgaggcagtaccaagttgccgtggcccatcggcagatttggttaaattttgaaaagtcatatagactccttctgtaaatttttaaatctcataggactctcgccatcgccagccagcttcgacaggagtcccgatgtttcaccgagtgaaatatcggcaccgtttgagttgacctaaagctcaaaagatgctagaatccatcttacctcgttaggggcgttttttcaaacgcccctatattgcgtgtcttcgcgcgtcgtagcgctgatgctgcgcctgtgtcgactatccgtttgtaagtactttcgatgacaccagcagtggctactcatgactggtgcgtgcgggtctaaagcagcagggaaaggaatcgcagtagaagccgcttgattcctatcacccctgatggtactatcagtactaacagagcagggcttactcgatgcgtgagaatcggggacatgctgagcctctcgtaggtcattggcctgctgggcgtcagtgtggcgcggttcgatccagtgaactctatcagctctgttagtactgtcagagttgatatattcgaccccaggaggagcccatgagttacatcgttcgcaccggaaatttggtcgacacccccgagctgcgtgagggagagcatggcccgtacacctacgctcgcgtcatcgtgtccgatcgcattcgccaggaggacggcagctacgtcaacgggccagcgatcgcctacgacgtcttggcgggtggcagccaagccgtgaatctggttgaagccgccaaggcgagcggcaacatccgcatcatgttcgcgggccgttaccgcgtcaccgagtggcggggtgagcagggcactcgtatccagcatgaggtccgagccgacgaagtgagcgtgagcctgctcggtcagagggtgaccgtggagcggcctcgaggtgacgtggcatccaaggagagcacgtcgttctgattgagtccgggggcacggtggtcgccgtggtaaaccgtgcccctgacagtactattgacactattggaggtatcagtgtgactgttcaaattttcgccttgtgcaaccagaagggtggcgtcggaaagtcgacatcgacgtttcatctggcccgtgccgcggtgttgcgtggccagcgtgtgcttgtcgtcgacaacgacccccagggcaacctgacgtctgtcgcggccgccgagcccgtgggggaggatcaggcggggctggccgatgtgctcagcgcgcgtgctccagagaccctccgcgatgtgatcgtgccgggaatctggtctggcctcgatgtcgtgccgacgtctggcatcacgctcggctgggtgcgtgacgaactcgtgatcgccggtgccggccgagaaggccggctgcgggaggccctggccggcgtcgaggacgactacgacgtgatcctgatcgactgtgctccatcgctcgatcagctcacgatcaacggcctggtggccgcccagggtgtcatcgtcgtgacgcactcgaagttgtggagcgccaacggcctcgcccagctgctcgacaccatcgacagcgtgcgcagctactacaacggcgcgctgcgcgtggcgggcatcatcgtcaaccagcacgaggagaacaccatcagcgggaaaacctggctcgacgagctgcatcaggctgccgagtcccggaagctgaccgtgcttgacccgccgatccccaagcgtgtcgtcatcgccgataccgtcgaggccgcgcgcggtctcgacgagtggggaagtgccgaggcggccgcgctcggccagttgtacgcccaccacctgacctgcatcgaaggagccctgtgatgacccgtccagccccccgaaagtcctcattgagcggatcaactccggtcgccccgccggctcagacggcgccggcaccgtctgccgcacctaccccccacaaggccgatgagtcacagacgagcagcaccacgaggaagtggcggcacaaggtgtcgttctaccaggacccggccgacaccgaccgggtgcgcggggcgatcctttacacgatgacgaccgagggcaaccggaacctgagccagttcgtcaacgatgccgtcatggccaaggtggtcgagctggaagtcaagtacaacgatggccagccattccccgctgtgggagcccgaggactaccccagggcggtgcagccgccgccggtgagtagaggaccatcgaccgtcgggggcttcaccatgcccccgaccctcggtcatcctgatcctcttgtcgatggtggtgacagtgggggattcacgcctcgttcagatcagaggaagtctcaccgcgtgattagtactatcaaatctgacagtactaacagagcagatagggttccctaggtcgagctgtatcacgccgacaaccagtgagccagtgatctacgaggggcgcaatatgcacccgatcggtagccgcgaaggcctcgccctgccccgatagtactatcaccactatcaatggtgctagtggtgagtttcttccattgatgacaacagcacagtgctgccgtctgtgtgcgggccaccagcccgcacacagttgccgtcgaggacgttgttcatgctctgtggtggccggtcctgagggcggctcgcaggatctcccggcgctcacggcgacgagcctggtagccaaggtctgcatgttcggcggcgagacgggctttgagggttgcggcttctgcacggcggtggagttggtcgtcgatgagttgggcgcgggccagacgccgcttatgggggttgtcgtgggtgagggtggcgtcgaggctgccgtcgtgggttagggccagggctgctcgttcggcgtcgtcgaggccgatgtggtggacggtcacgggtgcggtggtgacgtcgaggatgtccaggtggatgttgtggccgccgccgggggcttcggggaagtctggtgggctggcctggccggtgtcggggtcataccaggacaggccgatgatctcggcccagggtgggggcgggcagacggctcgcagaagggtgtgggccaggaacgtgttgcgggccatgatgcctccaagggtgaaaagcagtcgagtagcgatgacggcggggtagccgtctgctgggctgaggccgaccgggcccatgtcctcgatgctcttgtgctgcggccataccccaaagctaccaaacagtctttttaatctcaaagatacaaacagtgcttgacatattatctgcagcgaaagatactttcatcatggtggctgatcatgattacgcgactcctgacgatgagtggatgacacctcctcaggtggcccgtgtgattccgaacaccactgctcaggctgtccggcgctgggctgaggagggtcagcttcctggggcgtttcgtactccttctgggcgttggcatattccgtggtcggctgtggtgggcatcatggggtttgatccgcgtgagtccgcatcaccgagtgatcgtcaccagagctgacagagtcgtcgatgagctttcgagtgcagagctgatggcacgacggtctggatacttgtggagatgagagacgaccacatccagtcatggtcggggtacaccgaggggcagattcagcagtgctggcacgatgaggttgcccctgccattgactcgctcatggagcaggtaaggtctgttgccgagactcctgtgccgccgggttcgagattttacggcgatgagcagtgggccaagccttttcatccgtctactgcgatctgcggttcaatgggtccgccagcgatcacttgcacgcgctgaagctcctcgtctgggaagcgaacgtccaccatgtctatgcgccgtacacccttgctcgtgcatctattgaggcatcgtctactgctgtgtggctgttgagcacgaagacgcgcggagaacgtgtgctgcgagccttgcgatggtacgcgcaggattgtcacgactcgtgcaggttcatggatgatgagcagtatcgtgaccacctattgcggcgcattgaggggactgtcgctgcgggaaatctcgactcgcgcgctgctaggaaacggtaccgtgcaaccgatgttgtcgatgaggctgatcagctggttcccggaactctgagggcgtggcgagctttttctggtatggcccattcccgtatgtgggcatccagggggctgctcgacatggaagtgctgtccagtggccaaggaatggttacggcgaaggtgacgagcggatcggcccaaatcctttgggccgtcgtggcagctctgaatgttgctctcagtgccgctcgcttgtggcgtgattcgatgtgctcaccgtttgctgttgcccagtcggtagacgcgatgccagaggcgtttcgccgccctgtttagggtctgatcggggtagtgggtgttcacggggtcccaggttggccatggggcggcttggtgatgtgagttgggttgtgtggcagcctgggtgttgggtgtggcttcgttggccacgaaggcatgctcttccttgtgctgggacttgagtccccagtgctctcccctttgctagtggggggtggggtccccggaggtaggtcctccggggactttttctatgtctgtccgtgccccaggatttcgtatctaggcagtaccaattttgggttagttggaggtttctttggtaatggacagggtgagggtgatgaagaggtggccgtccttggtggcagaaattttctcgaacttcagctgaatgttgttatcagccactatctgttgggcggtgaggtgctcggagagcttctggaatccttcgcggatccacaggttgtaggggttggtgaccgagaccgaagggtatgggtcgaccttcagcgtcaggactggctggtctgggttgagggagttgatcttcaccagtttggggtaccggtcgcactcatgtgtctcttgtgttgggggccagcagtcgggggcccattcctcccagtggtcacgcatctcacgaagtactttcctgcatctcagcctctgcaggagctcgcgcgccaccgatgggagggctgccatgatgagggcaaggactgcgaacccgatgatgtaattgaccgtgtccctcgtcacgccgttcttgccgaggattccgatggcgaacgcgatgacgacaccgcccaggcacaggtgcatggggtcatgctgtgatggtttttcttcttcagcgactggtggggctatagtcatgtgtgccccttagtactaagtgatactggtgggttgcttttccccggtggccgtgtgcaagacggccaccggggttttccttcatgttcctgattttatctgcccggtgtggcgttttcatctttgtgtgggtggttcgcctggggtcttggagtgtggtgacgcggtgatggtcacggtgacggtgactgtggcgcgtggcgggtgaggtggttctttcctggtctggtgtgtggcccaggtgagtgtggtgatgagggccagggtgaggatgatgaccagggtggggagtagtttgtctggccggtgtcgccgggcttggtggcgcggcatgtttttccagggtgtgtctccgaacaggtcgtcgtcggaggggtcgtcgtggttcatagggtggccttggcgatggtggtgggcgagtttggtccaggtgatggtgccgtcggaggcgatgtggcggtcggcgggcagggtgtggacggtccatccggcgtcggtgagggcggtggtgaaggatttcttgatggatcgtttgggtaggtcgatgggggcgtgggtgccgacccagatgcaccggtttttgaggtgggtggcgccgaggtggttcatgtcgcggaccatgttttgggtgagtgtgagggtgtcggggtcccattggacggggatgatgatgtggtctgcgatggtgatggcgtgttgccaggcggcgtcgaggtcgttgtttccggtgtcgaggatgatgacgtggaagcggcttcttagggcggtgatgatgcggtcgaggtcgtcggcggtggggggtgtgatgaggctgttgtggttgtcggtgatggtgggtgggcatgtgatggtggcccagccttctggttgccaggagatgtaggggtcgaggtcgcggggttgggaggcgaatcctgggtgacgggctgcgcgggcgaggtcgatgacggtgttgtcggtgtggcggggtgcgcgggtggagagggtgccgcgtgggttgatttccacgacgacgatgtcgtcgtgtcctgctgtggtggcgagggcttgggcaaggatgacggccagcggggttttgccggtgccgcctttgaggttggcgagggtgatgatgtggtcggtgagttgggcgggtgcggcggtgtggtgagggttggcggtgaggttggcgatggtgaacagggcatcgagatcgtcggtggtgttctgctcggtgggttgggggtcgccggagatgatcgggtcggcgcggcgcggctgccatgccggcctcaccactgtcacgaccaccacgggtctgctggcgctgtgtgggtgtcgtcggcgatgactcacgatcggcagtctcaccatcgtctcggtgatgctcggctagcgctggacccggtcaagttcgggccggctcacccagtggtgatgactcggtcacagaaccgctgccggtcgttatctcggacgtctcgactcctccagtcctgatgggcgttggagccacctacacctactctcagaacgaccccgacctcgtgtggggcgggggcagatgtcacttgggccaatcgagagcccaggtgatggggaaagcaggggtgtgatatctgtcctggaaaactgggcagctgctaccgtggattgacggatctccacgaaagaagggaatgcgaccatgcagatcaccgtcaagaccatcaaagatcatcgggttcgcactgtccagaccgccatgagcagcgccttggggattggttcccaggtagacatgctcgcccccggcggttccaccagctcgagttccggttcatgctgctcgtgctcgacctgcgcggtagtggcgcagcctcaagactgaacggctggtcagccccaggggcgtggcgctcatcgcgtcacgccccttctattcgctggacagggtgcgcgagctgaggaacatcgcggtgtgtgcgatgacgaggggcaggagcaagtctgtgcgggttgccaagtagccctgcgcgatggccatcacgctggccccgacggcggcgaagacacctccgatacgtcgcttcatgccgccgaattgcatcaggacgaataggactcccgcggtccacatccctccgggcatgcatctgggaaagatgaaccggaagatgatctcttcacaggagagctggagtactagcagcgtagcccccacggggagactcacctctactgacagacggatcgtcttcatccacccacccgagctggcatcgaccatttcggtggccatgcgcgaccggtggcctcgtgcctctcgctgcgtgtcgatccagccgagcagtccgtggacgctctccgctaggactcctgacgcgacagtctcaccaattcctaagcccacggcgaggaccgcgacgcccccctgcacggcaggctgtgtgacttggtggtcccaccaacccgccggcaggaccatgcgtgcgaggctgcacacgagcaggaggtggagggtcacgacgagcgacatctggaataccgcttgccgttcggcgatggtggcgttgggaaagagcggtaggccggcacgggcagcggcgctcgacagcttccgcaagagcggtttggagacgaagtagtaggcgacgtacagcgccagcgctgtcgcgatgatgatcatcggtctgccaccgagctgacccgccgatagccgtttctgttccaccaatactggctgttgtagatcaggtggcccagaacacaggcccagatcccccagaagatgaacaggatagtccccaaggcggcgagcgggatcttggagaggacctgtccccgtccgaacaccgagtggccgcaagcaaacaagagtgctcccacagcggtgagcgcgagccaggccggggttgctcgcagactgatcaccgggaccccgacccggaagccgacctcttctcctacagcgatgactagcaactgccacagcggcatgttctgaacggagcgcgcgactcgggctcgagtcacccacacgggctgttgagcgctcacatcaccactcaggtaccccggtgaggcacttcgcttagtactggggcccgatgtgcgagcattcgtgatgtgtcgcaggatccggttgtcaagccaagaggccagcagggctccggcgacagtgacgggtagcccgatcagcacgaggccccagccatgcggtgccgagaggtttctggccggcgtgcacgcgaggcaggcaagtgccaacactgccagcactacgacgtagatggtcgcataattcgacttgcgggtgacgttgccgaccatcttggccaaagtcgctggggaccagctgatgagtgcgatggtggtcagcaggaagcaggaccagacagacatccggcgcactcaggggtatgggtgcggctgtgggttttggaaaccgccatatgcggcgtagcgggggtgtgcccgcatgggtgcgctgggcagtgacagggcgagcagcccaggcgcccagagcctgacacagtgcagtcccagcccctggatctctatggtggtgaaatcttcgatgtacaggggtgacacacaggtgatgctgttgaccacgctctttaccagttccgcccccgtgtgggtgtcgtcaggtggcaggtcttcggcttgggcaatggtgcccgcgtcgaatttcgccacaactgattgcgcggcctgatagttcctcgcgtagtaggagacgttcgagtcgaggtcaagcatgtcctccgtggacatactggacgcgtcggcctcggcgtcgaaagacgtccataccgcgagcatccgaaccccgctgcactcgagaaacgccttgtacatggctgcttccagacccgcgtctgcacctaggccgacggcgacgaggggaagttggttgccactaccgaccatcatgcatgccacggtgaaatgcttgagcccgggagtcggaagccagtagaaacgcagttcgtggcttcggcccgctgcacgttccacgagccgctggatgcgctggaggcggggtccttcgacgcggatgcgcacaggtgacgaggctccataccacaggcccatcgcggcatctacctggatcaattcataagccgcggacagcgttgcggcgacgcgtgaagtgtggacggcggtgccggtcgtcacggccgttcccagccacggctcaccgtcgtgccgacgggggttgtaacccaggtaaaagaactgcgccgggatccactcctgccgggaggtcccgacacggggagtcttgacccatgtcatgggcaagtcgtcgcgataggtgtcgaacgcacctccagccactcgttgcgcgaagccgaatgcgcccagatcgagaacttcgtcctcggtccgggcgaggagttcctgacgagtcgcccagcgccgttcgaagggactatggagaatcccggtacccgcgcagtagcgctcgacggcctccgcgtagaccttgatctctgcctcaaactcgttcagccccaccccaccgatgtggtagctacccggcttggggtcgggccggtcaagcagtgcgtgcatccccgtgagttccccaccgttcacccgcacgcgggggccgagcgcggggtgcagcgagtagccgacggaagtcaccagcccgcatagcgggctgtaggtgcgccgcctgagccgggctgcggtctcgacggggtcgctatcctggcgaagcttcatcgctcgccccctgccgccagccactcacggatgtcgtagtacaggtccggagcggtttcaacctgcgctggtgcatcaaaacgggacataggtaggacgtcgttgtaggcgatctccatcgtcggtatgtagaccgacaacactttgttgcgcgtcgtgttgaggccgttgcgggcgatgctgacagcctcatgcgcgacgtgcgcggccaagatcgcgcgcaccgacgctgccacggccggcgctccggcccttacgcggtcggcagcggccacccgcatccaggacaggtagctctgccgttcgcgcaggttcatcgcgacccgctgctcgaaggtccggtaggacgaggtcgcaccagggacgacgtagggacccacgtacaaggccggcccgtctacagctgcgtggagccacgacaggtgggcgcgtcgggcgaacaggtcaagggcgcgcagcatagccgggttgttctgcgccagcgctaccacaaggagtggctgcaggtccggcgccgaacccagcaacgccaacatctgggaggcctcctgctccatgtgcaactcgtcggccgactgctcaagccgcaggcctgcgaagagggtggctgatggctgcgtgtcgtcagcgaggacggtagcctgcagcccctctccctcgagaatctgctggatatcgccggcgaggagcgcgtcgtcgctgaatacccacaccgggcgcgtctctctacctccatccatcttgtcctcaacgttttcgaccagcgcaccgatcgatgctaggtgggccatcacgtcgtcaagggccgcgcgggtcaatccgggcacccgggacacgatctcgggcggctgcagtccttggctcaacaagtccaaggccggccacagggtcccggtggcgtcgtcgtcctccagcgttgtgctctcggcgttccagacgcctcgacggaactccaccctgtccatcgagtaaggcaccatcatgaggcccggtgaaatgtggttggtcactttggctcctgtacagcctaggcttggacgcccacggtcatggtgtgggtcgcggtttggaaaatcccgtcgaggttgagtgcctgattgagttcgtcctcgtagaagcttgaggactcgactgaggcaagaccgagccccgtgcagaccaagttgatctgttgtgcgatcgccccgacttcttgaagggcgaacctcaaacccctggctccgtacttccgcatcgccctccacggcgagatgacgaacaccaagtgcactccggccgcatccgattgctccacggccggctcgccggccatcgaattcctcacgccgcgacagccctcttcaccggtcacgggcaccagtcgatcgatgaccggcgagtagcggtagacgccgcgactcaagccggacacccgttgtgcggacatgaagatagacacgggatacagccctccaccagacgggacagcgcgtacattataccgcacgatatcaccgctcgaacgcgggacatccacgtgccccgtcacaccggcagcacctctcagaaacgcagctacgtcacgcaggtctagggattcgccggtgtagttccgtccgctgcgccggcgggcgatcacttgctcgaggggtgcgcgcaccctgctggacctgggaagttcgatcacatcggcagcgaacgtgtcgcgatccatctgtccgtacgtaacgatcatggggtcaacgaaatagtcgccgaccgagacgttgaactccatatccccccgggcgatgcgcgaggcgagcaagaagtctgcagctgcgttagacagccccggcccatcagtgttgtcgcagcggaactcgtgggtccgaaaccccacaccttccgtgcccgggctctgcgctcgatacgacgtgatcgcagaactagccttccttaaaccgcccggagtagctaccatgaccgtcccctctgaggtctcccgaacacttgcgacaatagcagcatgtgggggcagccgccagaggcgggcatccttgtctcgacaaccattgacctccggattcgatatgtgcataatcatagtcgtgccaacacgaaacgtgtacgtctcggaagacgacctagacctgttcgccgaagccaccgagatcgctggaggcctgtccgcagcggtgttggaggccttgcgcagctacgtagacaggcaccatcgcgcggccggcggattcgacgagatcgagctggagctgcagaacgacggtatcgaccaccgtgtcaccttcatgggtcgccgcctgatacacatccgccgtccagatcccgagggaacccgcatagacactgtctacttgaccgccaaacaccaattcgccgttgccaccaaaatccaacgacggctgccagactggacgaccggccacgagcacatctggtccgacccggagacctggaatcgggagttctggatcgcaggtgacaagacgatggccgtgtatcccagccttgacaaactccgcgaagctgaccccaatgtggccgaacgcgccgaggccacggtcaaaatcccgccgttcgaggtcctggacatctgatgacagaatcatcatcttcccggcggcaattggcaatgccggtgctgtcagtcacggatctagccaagaaatacgtggttcatggcggctacgaggtcccggcactcaacggtgtctcgtttgacctgcacccgggagagatgctgggtttgttcgggccaaacggtgctggaaagacgacgctggtcaggatcatcgcgggcctcttatcggcagattctggagacgtccactggggatcggatcaaggtcgggccaggttaggctacgtgtcccaaaagggtggactgcagtacgggctcacgtgccgggaagagatggtcttccacgcacaatgcttcggccagtccgccaagcaggcccggactagcgtcgacgaggtcgccgcgatgctgcactgcgattacctgatggagtgggacgtcggaaggctctccggtgggcaacgccgaatcatcgaggtagggctagcactcgtcaatcaaccatcggtcgtcctgctcgacgagcccaccctgggcctggaccccgcaacacgcctgtcgttgtggcaaacggtaaagtcggcacgccgtgagaccggtgctgccttcctcgtcaccacccactacattgacgaggtggccgagcacctgtccaacgtcagcgtgatcaaccacggaaccgtcgtcgccaacggctcgccagcgcacatccgagaaatgttcgcgaccggggaagtaacgctcggcgtggccgaggatacggtggacagtgcggtggacgtgttggctgggaccgcgttcgaggcgcaccccaccgaaaccgtcccggggatcgtggtcaggtccaggcatcccgacgtggacgcggccaagatcatcaccatcctggctggtcatggcatctcggtggactccatatccgtacgcgaggcgaccttggaagaggcgtttctcacgatcacaggcagtcgagacccggagaggcaaatcccatgaacacttgcttcaggcgatatgcggcgatgtcgctgagagcgcggcgtgatttggccctgacattcatccagcccctcgtctacctagccctcttcggaccgctcttcgtcacgacgatgaagatgtcgcagagagctaccgccgctacgggttactccctatacatcacgggcctgtccatccaaatggccatgacgatcggtgccttcgcggggctaaccatcatcctcgaataccgactcggcatcctcgaacggatctggagcacccccctcacggggagcaagatgatggcggggcgaatcgcgcgcgacgtcgttatgatgatgatgccgatactggtcgtcttcatcatcggcctggtgctgggaacacgccccagcccactgggcctggcgacctacttcgtgacagtgctcggcacaggagccacgttcgccggggtctcctacgcggtggcactcagaacgaagagcgaggcagcgctatccgcgatcttcaacctcatcctgctacccatcctcctgctgtcggggatcatgctgcccatgtcgttcgcaccacactggatcgccaccgctgcccacgtgaacccgttgtggtacctggtgcaaggcgcgcggaaccagttcagcgttctagggctcgtggcggcggccccatggagttgggctgtggccatcgtcatgtcagccgctgccttcggctgggcaagccacgaattcaacaagaggcgctgacacaaagaatggtgccgggaacccaggtccccggcaccaccgagtgcactcgcgacgtcaacgcaccgttgcggtcactgcgcaggtcgagcacgaggacgacgagcccgcgctgctgcaggtcgagccgccaggcgcgagcaggtcgacgttagcgtcggcgccgccgaagacggacgtgacggccggctgagaggtgcggatgcggtgctccagcgaggaggtggtggtgagtttcatgggaggtgctcctaggagtgagacgagaacaaaccctagcgataggttagcagtccgcaaccgactccgggaatagtagaagcgcgcatccgtagcggaagaccttagcctgattacagtgaccctgttcgcgtctcaacattattccacacccccgagcagcgaacgacaccgcgatgatgatccgtcgcctctccaccgaagaactccgcgcccacatcgcaccgggccgccgtcccgtgcatcagacctgccgtcaacgtcggccatgaagctgggaaggtggctctcgtctaggagcagacgcgggacgcctcctccaggttgggccggggaagtgtccggttcttgatgtaggtggcggtccctattgatgggcgttgaccgtgggaatgcggtcggcgaagggggtggcgaacccgttgagcgcaggcttccagcgcatgcatcaacgctgtctgccggccaccggcaagcctcacccgcccgtcatggccatcatcgaggtgccggtgaatcctcgacacatgatcccaactcccccggaggggcttccggggctgttcagccaccagatcagccaggcggcgagcccgactctgccacccggaccctgcagagcgtgcctgctgccgtcgtgtcgtgtcgggccagtgggccaccagatcggccacatccgtcttggcccatctccagcccgccagacccagggaggccatcacctcatcgacgccgcgccgggtggtctcatcaaccccgtcaaacagctcgggccacctcgatgatgccgtccgtgaacgatccagattcatgacatgctcctcttcacagatgccgacgacgatcaggccgtggccgtggcaacggggtgacctgccggcgcggctcacgacgttgagccggaaccacacgagacgcaccagtgtgctgcgccgtcttgagtcgggcgctgtactgggccctggcgctgtggtgaacagcccgacgaagcaccgaccgccggctgtcctcatcgccagggcgaggcatggggcgcggcatggtgcgcccggtagcagcatccatgagggtgatccggtcagccaaaatgccgagccggttttcccacttccggggccacggcaccagcaggtcacgctgacagcccacgccgtggcgtcggcagtccacaacattttctcacggccaggatgcgagtgcagcagctccaccggaacaccagcatcacgcacccgccgcatcgtgacctcatcctcacgtgccaccagcgggggagagcgactaccgctgcagccggtccaaagcgactcttcacagatgagggggtggatcggtagctgacccctaggtcctgatgtgggtcgaggtccttg

SEQ ID NO: 102 - DNA, 599 bp, Propionibacterium acnes; identical to SEQ ID NO: 100

SEQ ID NO: 103 - DNA, 17061 bp, Propionibacterium acnes
gtgttccagtgcctcgcgggcgtgatgttcttcttcggcaccttcttgccacatgcttcgcgcttcagcctcgccatccaagcgaacctggactgtgaacgagtcctcatcgggtccgtcctcattccacgcggcaatgatcccacgggcctcgtctgcgacctgactcaacttcatcgcctgcccgacagccccgagagccggaatctcgaacacccagatattcgcctcagccgagacctcacgatgggcgatcacttcgtaggtcgtctcaccttctactgtcgtgtccattacttccactccttcggaattttcacgcctgctcgctccagctgtgccaggacaccaactgacgtcagctggtgtcctgctggtatcgatacgcgcccggctccgccggggcgtccccagatttcatggcttcccttggcgttccgcagacgggcccatccttgagaacggagcagcttgaggacgtccttagttttctgcggtttcacacatcatagtatagccccacttaacttgtaaactaagcccctgtttacattttagttggtgcatgtgatccctgctcttatgacgtcgcccgacctggcgccttagacatgcactgttcatcctcaaccacactcaccgtcacgggtccgaaggcgaggtctatcaccattcgcatcgatgaagttgaagcaggatcgtccgcatcacgcactgccgatccggacagacgccaccggccgtaccgactgtttacgatctgccaccgcagactgctgccataaccgctatcacctctgatagtacgtttagtactatcagaggtgattcaagattctcctgtcgagcagccctacagtcacgaagtcctgcgatcgtcatcgcttaaggcagacggatggccatcggggaccactcgcaaagcaggggcgatcagcaacagtgatgtgccatgagcaagtactggtgcaccggctgtttactccgcccctagataaaccacgggtgcaggggtggacaccacaccatgaccgatgtggtgcccaccccatggctcacaggcaggccctatcgccgggagcactgctgcagatgaggctcagtaacctgccatgtctcacctggggccaaggtgccaagctccccacggaatctcaggcatcggaaaccagcagccgaacttccacagcatgagcgccctacgaaaaagcaggccgccgacggttctcaagaactcgccggcggcctgcatcgccactcgaactgtaaccgtggtccgaccccgtgcacaggtaagctccacactcccaccaggcatggccgaggcagtaccaagttgccgtggcccatcggcagatttggttaaattttgaaaagtcatatagactccttctgtaaatttttaaatctcataggactctcgccatcgccagccagcttcgacaggagtcccgatgtttcaccgagtgaaatatcggcaccgtttgagttgacctaaagctcaaaagatgctagaatccatcttacctcgttaggggcgttttgtcaaacgcccctatattgcgtgtcttcgcgcgtcgtagcgctgatgctgcgcctgtgtcgactatccgtttgtaagtactttcgatgacaccagcagtggctactcatgactggtgcgtgcgggtctaaagcagcagggaaaggaatcgcagtagaagccgcttgattcctatcacccctgatggtactatcagtactaacagagcagggcttactcgatgcgtgagaatcggggacatgctgagcctctcgtaggtcattggcctgctgggcgtcagtgtggcgcggttcgatccagtgaactctatcagctctgttagtactgtcagagttgatatattcgaccccaggaggagcccatgagttacatcgttcgcaccggaaatttggtcgacacccccgagctgcgtgagggagagcatggcccgtacacctacgctcgcgtcatcgtgtccgatcgcattcgccaggaggacggcagctacgtcaacgggccagcgatcgcctacgacgtcttggcgggtggcagccaagccgtgaatctggttgaagccgccaaggcgagcggcaacatccgcatcatgttcgcgggccgttaccgcgtcaccgagtggcggggtgagcagggcactcgtatccagcatgaggtccgagccgacgaagtgagcgtgagcctgctcggtcagagggtgaccgtggagcggcctcgaggtgacgtggcatccaaggagagcacgtcgttctgattgagtccgggggcacggtggtcgccgtggtaaaccgtgcccctgacagtactattgacactattggaggtatcagtgtgactgctcaaattttcgccttgtgcaaccagaagggtggcgtcggaaagtcgacatcgacgtttcatctggcccgtgccgcggtgttgcgtggccagcgtgtgcttgtcgtcgacaacgacccccagggcaacctgacgtctgtcgcggccgccgagcccgtgggggaggatcaggcggggctggccgatgtgctcagcgcgcgtgctccagagaccctccgcgatgtgatcgtgccgggaatctggtctggcctcgatgtcgtgccgacgtctggcatcacgctcggctgggtgcgtgacgaactcgtgatcgccggtgccggccgagaaggccggctgcgggaggccctggccggcgtcgaggacgactacgacgtgatcctgatcgactgtgctccatcgctcgatcagctcacgatcaacggcctggtggccgcccagggtgtcatcgtcgtgacgcactcgaagttgtggagcgccaacggcctcgcccagctgctcgacaccatcgacagcgtgcgcagctactacaacggcgcgctgcgcgtggcgggcatcatcgtcaaccagcacgaggagaacaccatcagcgggaaaacctggctcgacgagctgcatcaggctgccgagtcccggaagctgaccgtgcttgacccgccgatccccaagcgtgtcgtcatcgccgataccgtcgaggccgcgcgcggtctcgacgagtggggaagtgccgaggcggccgcgctcggccagttgtacgcccaccacctgacctgcatcgaaggagccctgtgatgacccgtccagccccccgaaagtcctcattgagcggatcaactccggtcgccccgccggctcagacggcgccggcaccgtctgccgcacctaccccccacaaggccgatgagtcacagacgagcagcaccacgaggaagtggcggcacaaggtgtcgttctaccaggacccggccgacaccgaccgggtgcgcggggcgatcctttacacgatgacgaccgagggcaaccggaacctgagccagttcgtcaacgatgccgtcatggccaaggtggtcgagctggaagtcaagtacaacgatggccagccattccccgctgtgggagcccgaggactaccccagggcggtgcagccgccgccggtgagtagaggaccatcgaccgtcgggggcttcaccatgcccccgaccctcggtcatcctgatcctcttgtcgatggtggtgacagtgggggattcacgcctcgttcagatcagaggaagtctcaccgcgtgattagtactatcaaatctgacagtactaacagagcagatagggttccctaggtcgagctgtatcacgccgacaaccagtgagccagtgatctacgaggggcgcaatatgcacccgatcggtagccgcgaaggcctcgccctgccccgatagtactatcaccactatcaatggtgctagtggtgagtttcttccattgatgacaacagcacagtgctgccgtctgtgtgcgggccaccagcccgcacacagttgccgtcgaggacgttgttcatgctctgtggtggccggtcctgagggcggctcgcaggatctcccggcgctcacggcgacgagcctggtagccaaggtctgcatgttcggcggcgagacgggctttgagggttgcggcttctgcacggcggtggagttggtcgtcgatgagttgggcgcgggccagacgccgcttatgggggttgtcgtgggtgaggggggcgtcgaggctgccgtcgtgggttagggccagggctgctcgttcggcgtcgtcgaggccgatgtggtggacggtcacgggtgcggtggtgacgtcgaggatgtccaggtggatgttgtggccgccgccgggggcttcggggaagtctggtgggctggcctggccggtgtcggggtcataccaggacaggccgatgatctcggcccagggtgggggcgggcagacggctcgcagaagggtgtgggccaggaacgtgttgcgggccatgatgcctccaagggtgaaaagcagtcgagtagcgatgacggcggggtagccgtctgctgggctgaggccgaccgggcccatgtcctcgatgctcttgtgctgcggccataccccaaagctaccaaacagtctttttaatctcaaagatacaaacagtgcttgacatattatctgcagcgaaagatactttcatcatggtggctgatcatgattacgcgactcctgacgatgagtggatgacacctcctcaggtggcccgtgtgattccgaacaccactgctcaggctgtccggcgctgggctgaggagggtcagcttcctggggcgtttcgtactccttctgggcgttggcatattccgtggtcggctgtggtgggcatcatggggtttgatccgcgtgagtccgcatcaccgagtgatcgtcaccagagctgacagagtcgtcgatgagctttcgagtgcagagctgatggcacgacggtctggatacttgtggagatgagagacgaccacatccagtcatggtcggggtacaccgaggggcagattcagcagtgctggcacgatgaggttgcccctgccattgactcgctcatggagcaggtaaggtctgttgccgagactcctgtgccgccgggttcgagattttacggcgatgagcagtgggccaagccttttcatccgtctactgcgatctgcggttcaatgggtccgccagcgatcacttgcacgcgctgaagctcctcgtctgggaagcgaacgtccaccatgtctatgcgccgtacacccttgctcgtgcatctattgaggcatcgtctactgctgtgtggctgttgagcacgaagacgcgcggagaacgtgtgctgcgagccttgcgatggtacgcgcaggattgtcacgactcgtgcaggttcatggatgatgagcagtatcgtgaccacctattgcggcgcattgaggggactgtcgctgcgggaaatctcgactcgcgcgctgctaggaaacggtaccgtgcaaccgatgttgtcgatgaggctgatcagctggttcccggaactctgagggcgtggcgagctttttctggtatggcccattcccgtatgtgggcatccagggggctgctcgacatggaagtgctgtccagtggccaaggaatggttacggcgaaggtgacgagcggatcggcccaaatcctttgggccgtcgtggcagctctgaatgttgctctcagtgccgctcgcttgtggcgtgattcgatgtgctcaccgtttgctgttgcccagtcggtagacgcgatgccagaggcgtttcgccgccctgtttagggtctgatcggggtagtgggtgttcacggggtcccaggttggccatggggcggcttggtgatgtgagttgggttgtgtggcagcctgggtgttgggtgtggcttcgttggccacgaaggcatgctcttccttgtgctgggacttgagtccccagtgctctcccctttgctagtggggggtggggtccccggaggtaggtcctccggggactttttctatgtctgtccgtgccccaggatttcgtatctaggcagtaccaattttgggttagttggaggtttctttggtaatggacagggtgagggtgatgaagaggtggccgtccttggtggcagaaattttctcgaacttcagctgaatgttgttatcagccactatctgttgggcggtgaggtgctcggagagcttctggaatccttcgcggatccacaggttgtaggggttggtgaccgagaccgaagggtatgggtcgaccttcagcgtcaggactggctggtctgggttgagggagttgatcttcaccagtttggggtaccggtcgcactcatgtgtctcttgtgttgggggccagcagtcgggggcccattcctcccagtggtcacgcatctcacgaagtactttcctgcatctcagcctctgcaggagctcgcgcgccaccgatgggagggctgccatgatgagggcaaggactgcgaacccgatgatgtaattgaccgtgtccctcgtcacgccgttcttgccgaggattccgatggcgaacgcgatgacgacaccgcccaggcacaggtgcatggggtcatgctgtgatggtttttcttcttcagcgactggtggggctatagtcatgtgtgccccttagtactaagtgatactggtgggttgcttttccccggtggccgtgtgcaagacggccaccggggttttccttcatgttcctgattttatctgcccggtgtggcgttttcatctttgtgtgggtggttcgcctggggtcttggagtgtggtgacgcggtgatggtcacggtgacggtgactgtggcgcgtggcgggtgaggtggttctttcctggtctggtgtgtggcccaggtgagtgtggtgatgagggccagggtgaggatgatgaccagggtggggagtagtttgtctggccggtgtcgccgggcttggtggcgcggcatgtttttccagggtgtgtctccgaacaggtcgtcgtcggaggggtcgtcgtggttcatagggtggccttggcgatggtggtgggcgagtttggtccaggtgatggtgccgtcggaggcgatgtggcggtcggcgggcagggtgtggacggtccatccggcgtcggtgagggcggtggtgaaggatttcttgatggatcgtttgggtaggtcgatgggggcgtgggtgccgacccagatgcaccggtttttgaggtgggtggcgccgaggtggttcatgtcgcggaccatgttttgggtgagtgtgagggtgtcggggtcccattggacggggatgatgatgtggtctgcgatggtgatggcgtgttgccaggcggcgtcgaggtcgttgtttccggtgtcgaggatgatgacgtggaagcggcttcttagggcggtgatgatgcggtcgaggtcgtcggcggtggggggtgtgatgaggctgttgtggttgtcggtgatggtgggtaggcatgtgatggtggcccagccttctggttgccaggagatgtaggggccgaggtcgcggggttgggaggcgaatcctgggtgacgggctgcgcgggcgaggtcgatgacggtgttgtcggtgtggcggggtgcgcgggtggagagggtgccgcgtgggttgatttccacgacgacgatgtcgtcgtgtcctgctgtggtggcgagggcttgggcaaggatgacggccagcggggttttgccggtgccgcctttgaggttggcgagggtgatgatgtggtcggtgagttgggcgggtgcggcggtgtggtgagggttggcggtgaggttggcgatggtgaacagggcatcgagatcgtcggtggtgttctgctcggtgggttgggggtcgccggagatgatcgggtcggcgcggcgcggctgccatgccggcctcaccactgtcacgaccaccacgggtctgctggcgctgtgtgggtgtcgtcggcgatgactcacgatcggcagtctcaccatcgtctcggtgatgctcggctagcgctggacccggtcaagttcgggccggctcacccagtggtgatgactcggtcacagaaccgctgccggtcgttatctcggacgtctcgactcctccagtcctgatgggcgttggagccacctacacctactctcagaacgaccccgacctcgtgtggggcgggggcagatgtcacttgggccaatcgagagcccaggtgatggggaaagcaggggtgtgatatctgtcctggaaaactgggcagctgctaccgtggattgacggatctccacgaaagaagggaatgcgaccatgcagatcaccgtcaagaccatcaaagatcatcgggttcgcactgtccagaccgccatgagcagcgccttggggattggttcccaggtagacatgctcgcccccggcggttccaccagctcgagttccggttcatgctgctcgtgctcgacctgcgcggtagtggcgcagcctcaagactgaacggctggtcagccccaggggcgtggcgctcatcgcgtcacgccccttctattcgctggacagggtgcgcgagctgaggaacatcgcggtgtgtgcgatgacgaggggcaggagcaagtctgtgcgggttgccaagtagccctgcgcgatggccatcacgctggccccgacggcggcgaagacacctccgatacgtcgcttcatgccgccgaattgcatcaggacgaataggactcccgcggtccacatccctccgggcatgcatctgggaaagatgaaccggaagatgatctcttcacaggagagctggagtactagcagcgtagcccccacggggagactcacctctactgacagacggatcgtcttcatccacccacccgagctggcatcgaccatttcggtggccatgcgcgaccggtggcctcgtgcctctcgctgcgtgtcgatccagccgagcagtccgtggacgctctccgctaggactcctgacgcgacagtctcaccaattcctaagcccacggcgaggaccgcgacgcccccctgcacggcaggctgtgtgacttggtggtcccaccaacccgccggcaggaccatgcgtgcgaggctgcacacgagcaggaggtggagggtcacgacgagcgacatctggaataccgcttgccgttcggcgatggtggcgttgggaaagagcggtaggccggcacgggcagcggcgctcgacagcttccgcaagagcggtttggagacgaagtagtaggcgacgtacagcgccagcgctgtcgcgatgatgatcatcggtctgccaccgagctgacccgccgatagccgtttctgttccaccaatactggctgttgtagatcaggtggcccagaacacaggcccagatcccccagaagatgaacaggatagtccccaaggcggcgagcgggatcttggagaggacctgtccccgtccgaacaccgagtggccgcaagcaaacaagagtgctcccacagcggtgagcgcgagccaggccggggttgctcgcagactgatcaccgggaccccgacccggaagccgacctcttctcctacagcgatgactagcaactgccacagcggcatgttctgaacggagcgcgcgactcgggctcgagtcacccacacgggctgttgagcgctcacatcaccactcaggtaccccggtgaggcacttcgcttagtactggggcccgatgtgcgagcattcgtgatgtgtcgcaggatccggttgtcaagccaagaggccagcagggctccggcgacagtgacgggtagcccgatcagcacgaggccccagccatgcggtgccgagaggtttctggccggcgtgcacgcgaggcaggcaaatgccatcactgccagcactacgacgtagatggtcgcataattcgacttgcgggtgacgttgccgaccatcttggccaaagtcgctggggaccagctgatgagtgcgatggtggtcagcaggaagcaggaccagacagacatccggcgcactcaggggtatgggtgcggctgtgggttttggaaaccgccatatgcggcgtagcgggggtgtgcccgcatgggtgcgctgggcagtgacagggcgagcagcccaggcgcccagagcctgacacagtgcagtcccagcccctggatctctatggtggtgaaatcttcgatgtacaggggtgacacacaggtgatgctgttgaccacgctctttaccagttccgcccccgtgtgggtgtcgtcaggtggcaggtcttcggcttgggcaatggtgcccgcgtcgaatttcgccacaactgattgcgcggcctgatagttcctcgcgtagtaggagacgttcgagtcgaggtcaagcatgtcctccgtggacatactggacgcgtcggcctcggcgtcgaaagacgtccataccgcgagcatccgaaccccgctgcactcgagaaacgccttgtacatggctgcttccagacccgcgtctgcacctaggccgacggcgacgaggggaagttggttgccactaccgaccatcatgcatgccacggtgaaatgcttgagcccgggagtcggaagccagtagaaacgcagttcgtggcttcggcccgctgcacgttccacgagccgctggatgcgctggaggcggggtccttcgacgcggatgcgcacaggtgacgaggctccataccacaggcccatcgcggcatctacctggatcaattcataagccgcggacagcgttgcggcgacgcgtgaagtgtggacggcggtgccggtcgtcacggccgttcccagccacggctcaccgtcgtgccgacgggggttgtaacccaggtaaaagaactgcgccgggatccactcctgccgggaggtcccgacacggggagtcttgacccatgtcatgggcaagtcgtcgcgataggtgtcgaacgcacctccagccactcgttgcgcgaagccgaatgcgcccagatcgagaacttcgtcctcggtccgggcgaggagttcctgacgagtcgcccagcgccgttcgaagggactatggagaatcccggtacccgcgcagtagcgctcgacggcctccgcgtagaccttgatctctgcctcaaactcgttcagccccaccccaccgatgtggtagctacccggcttggggtcgggccggtcaagcagtgcgtgcatccccgtgagttccccaccgttcacccgcacgcgggggccgagcgcggggtgcagcgagtagccgacggaagtcaccagcccgcatagcgggctgtaggtgcgccgcctgagccgggctgcggtctcgacggggtcgctatcctggcgaagcttcatcgctcgccccctgccgccagccactcacggatgtcgtagtacaggtccggagcggtttcaacctgcgctggtgcatcaaaacgggacataggtaggacgtcgttgtaggcgatctccatcgtcggtatgtagaccgacaacactttgttgcgcgtcgtgttgaggccgttgcgggcgatgctgacagcctcatgcgcgacgtgcgcggccaagatcgcgcgcaccgacgctgccacggccggcgctccggcccttacgcggtcggcagcggccacccgcatccaggacaggtagctctgccgttcgcgcaggttcatcgcgacccgctgctcgaaggtccggtaggacgaggtcgcaccagggacgacgtagggacccacgtacaaggccggcccgtctacagctgcgtggagccacgacaggtgggcgcgtcgggcgaacaggtcaagggcgcgcagcatagccgggttgttctgcgccagcgctaccacaaggagtggctgcaggtccggcgccgaacccagcaacgccaacatctgggaggcctcctgctccatgtgcaactcgtcggccgactgctcaagccgcaggcctgcgaagagggtggctgatggctgcgtgtcgtcagcgaggacggtagcctgcagcccctctccctcgagaatctgctggatatcgccggcgaggagcgcgtcgtcgctgaatacccacaccgggcgcgtctctctacctccatccatcttgtcctcaacgttttcgaccagcgcaccgatcgatgctaggtgggccatcacgtcgtcaagggccgcgcgggtcaatccgggcacccgggacacgatctcgggcggctgcagtccttggctcaacaagtccaaggccggccacagggtcccggtggcgtcgtcgtcctccagcgttgtgctctcggcgttccagacgcctcgacggaactccaccctgtccatcgagtaaggcaccatcatgaggcccggtgaaatgtggttggtcactttggctcctgtacagcctaggcttggacgcccacggtcatggtgtgggtcgcggtttggaaaatcccgtcgaggttgagtgcctgattgagttcgtcctcgtagaagcttgaggactcgactgaggcaagaccgagccccgtgcagaccaagttgatctgttgtgcgatcgccccgacttcttgaagggcgaacctcaaacccctggctccgtacttccgcatcgccctccacggcgagatgacgaacaccaagtgcactccggccgcatccgattgctccacggccggctcgccggccatcgaattcctcacgccgcgacagccctcttcaccggtcacgggcaccagtcgatcgatgaccggcgagtagcggtagacgccgcgactcaagccggacacccgttgtgcggacatgaagatagacacgggatacagccctccaccagacgggacagcgcgtacattataccgcacgatatcaccgctcgaacgtgggacatccacgtgccccgtcacaccggcagcacctctcagaaacgcagctacgtcacgcaggtctagggattcgccggtgtagttccgtccgctgcgccggcgggcgatcacttgctcgaggggtgcgcgcaccctgctggacctgggaagttcgatcacatcggcagcgaacgtgtcgcgatccatctgtccgtacgtaacgatcatggggtcaacgaaatagtcgccgaccgagacgttgaactccatatccccccgggcgatgcgcgaggcgagcaagaagtctgcagctgcgttagacagccccggcccatcagtgttgtcgcagcggaactcgtgggtccgaaaccccacaccttccgtgcccgggctctgcgctcgatacgacgtgatcgcagaactagccttccttaaaccgcccggagtagctaccatgaccgtcccctctgaggtctcccgaacacttgcgacaatagcagcatgtgggggcagccgccagaggcgggcatccttgtctcgacaaccattgacctccggattcgatatgtgcataatcatagtcgtgccaacacgaaacgtgtacgtctcggaagacgacctagacctgttcgccgaagccaccgagatcgctggaggcctgtccgcagcggtgttggaggccttgcgcagctacgtagacaggcaccatcgcgcggccggcggattcgacgagatcgagctggagctgcagaacgacggtatcgaccaccgtgtcaccttcatgggtcgccgcctgatacacatccgccgtccagatcccgagggaacccgcatagacactgtctacttgaccgccaaacaccaattcgccgttgccaccaaaatccaacgacggctgccagactggacggccggccacgagcacatctggtccgacccggagacctggaatcgggagttctggatcgcaggtgacaagacgatggccgtgtatcccagccttgacaaactccgcgaagctgaccccaatgtggccgaacgcgccgaggccgcggtcaaaatcccgccgttcgaggtcctggacatctgatgacagaatcatcatcttcccggcggcaattggcaatgccggtgctgtcagtcacggatctagccaagaaatacgtggttcatggcggctacgaggtcccggcactcaacggtgtctcgtttgacctgcacccgggagagatgctgggtttgttcgggccaaacggtgctggaaagacgacgctggtcaggatcatcgcgggcctcttatcggcagattctggagacgtccactggggatcggatcaaggtcgggccaggttaggctacgtgtcccaaaagggtggactgcagtacgggctcacgtgccgggaagagatggtcttccacgcacaatgcttcggccagtccgccaagcaggcccggactagcgtcgacgaggtcgccgcgatgctgcactgcgattacctgatggagtgggacgtcggaaggctctccggtgggcaacgccgaatcatcgaggtagggctagcactcgtcaatcaaccatcggtcgtcctgctcgacgagcccaccctgggcctggaccccgcaacacgcctgtcgttgtggcaaacggtaaagtcggcacgccgtgagaccggtgctgccttcctcgtcaccacccactacattgacgaggtggccgagcacctgtccaacgtcagcgtgatcaaccacggaaccgtcgtcgccaacggctcgccagcgcacatccgagaaatgttcgcgaccggggaagtaacgctcggcgtggccgaggatacggtggacagtgcggtggacgtgttggctgggaccgcgttcgaggcgcaccccaccgaaaccgtcccggggatcgtggtcaggtccaggcatcccgacgtggacgcggccaagatcatcaccatcctggctggtcatggcatctcggtggactccatatccgtacgcgaggcgaccttggaagaggcgtttctcacgatcacaggcagtcgagacccggagaggcaaatcccatgaacacttgcttcaggcgatatgcggcgatgtcgctgagagcgcggcgtgatttggccctgacattcatccagcccctcgtctacctagccctcttcggaccgctcttcgtcacgacgatgaagatgtcgcagagagctaccgccgctacgggttactccctatacatcacgggcctgtccatccaaatggccatgacgatcggtgccttcgcggggctaaccatcatcctcgaataccgactcggcatcctcgaacggatctggagcacccccctcacggggagcaagatgatggcggggcgaatcgcgcgcgacgtcgttatgatgatgatgccgatactggtcgtcttcatcatcggcctggtgctgggaacacgccccagcccactgggcctggcgacctacttcgtgacagtgctcggcacaggagccacgttcgccggggtctcctacgcggtggcactcagaacgaagagcgaggcagcgctatccgcgatcttcaacctcatcctgctacccatcctcctgctgtcggggatcatgctgcccatgtcgttcgcaccacactggatcgccaccgctgcccacgtgaacccgttgtggtacctggtgcaaggcgcgcggaaccagttcagcgttctagggctcgtggcggcggccccatggagttgggctgtggccatcgtcatgtcagccgctgccttcggctgggcaagccacgaattcaacaagaggcgctgacacaaagaatggtgccgggaacccaggtccccggcaccaccgagtgcactcgcgacgtcaacgcaccgttgcggtcactgcgcaggtcgagcacgaggacgacgagcccgcgctgctgcaggtcgagccgccaggcgcgagcaggtcgacgttagcgtcggcgccgccgaagacggacgtgacggccggctgagaggtgcggatgcggtgctccagcgaggaggtggtggtgagtttcatgggaggtgctcctaggagtgagacgagaacaaaccctagcgataggttagcagtccgcaaccgactccgggaatagtagaagcgcgcatccgtagcggaagaccttagcctgattacagtgaccctgttcgcgtctcaacattattccacacccccgagcagcgaacgacaccgcgatgatgatccgtcgcctctccaccgaagaactccgcgcccacatcgcaccgggccgccgtcccgtgcatcagacctgccgtcaacgtcggccatgaagctgggaaggtggctctcgtctaggagcagacgcgggacgcctcctccaggttgggccggggaagtgtccggttcttgatgtaggtggcggtccctattgatgggcgttgaccgtgggaatgcggtcggcgaagggggtggcgaacccgttgagcgcaggcttccagcgcatgcatcaacgctgtctgccggccaccggcaagcctcacccgcccgtcatggccatcatcgaggtgccggtgaatcctcgacacatgatcccaactcccccggaggggcttccggggctgttcagccaccagatcagccaggcggcgagcccgactctgccacccggaccctgcagagcgtgcctgctgccgtcgtgtcgtgtcgggccagtgggccaccagatcggccacatccgtcttggcccatctccagcccgccagacccagggaggccatcacctcatcgacgccgcgccgggtggtctcatcaaccccgtcaaacagctcgggccacctcgatgatgccgtccgtgaacgatccagattcatgacatgctcctcttcacagatgccgacgacgatcaggccgtggccgtggcaacggggtgacctgccggcgcggctcacgacgttgagccggaaccacacgagacgcaccagtgtgctgcgccgtcttgagtcgggcgctgtactgggccctggcgctgtggtgaacagcccgacgaagcaccgaccgccggctgtcctcatcgccagggcgaggcatggggcgcggcatggtgcgcccggtagcagcatccatgagggtgatccggtcagccaaaatgccgagccggttttcccacttccggggccacggcaccagcaggtcacgctgacagcccacgccgtggcgtcggcagtccacaacattttctcacggccaggatgcgagtgcagcagctccaccggaacaccagcatcacgcacccgccgcatcgtgacctcatcctcacg

SEQ ID NO: 104 - DNA, 1527 bp, Propionibacterium acnes
accagatcggccacatccgtcttggcccatctccagcccgccagacccagggaggccatcacctcatcgacgccgcgccgggtggtctcatcaaccccgtcaaacagctcgggccacctcgatgatgccgtccgtgaacgatccagattcatgacatgctcctcttcacagatgccgacgacgatcaggccgtggccgtggcaacggggtgacctgccggcgcggctcacgacgttgagccggaaccacacgagacgcaccagtgtgctgcgccgtcttgagtcgggcgctgtactgggccctggcgctgtggtgaacagcccgacgaagcaccgaccgccggctgtcctcatcgccagggcgaggcatggggcgcggcatggtgcgcccggtagcagcatccatgagggtgatccggtcagccaaaatgccgagccggttttcccacttccggggccacggcaccagcaggtcacgctgacagcccacgccgtggcgtcggcagtccacaacattttctcacggccaggatgcgagtgcagcagctccaccggaacaccagcatcacgcacccgccgcatcgtgacctcatcctcacgctgccgatcaccgtcaaccagatggtcagccacgatggtgttcacaccccatgactcatgcagttgcctggccaaggcgcccaacacctgctgacgcacctgtgacttgacgtcatcatcctccagatcctgtgtaccaaccatcacggaggccaacacatcactgcgttgctgaaccagggtgttgacgacgtcgacatcgtcgatacccatgggattgttggcgcgcgcggccacggcatgaaacgtgttggactgcaaattctcgaccagaccacgccgatagtcgttgaactgggaggtgtcggcaatgacaccggtcatgatgtaggccgacccctcggacaaggccctgtaggactcgtcgacgaacgccaccaaccccggccgccgccggtaaagtcgacctgcttcctcgtcagccagcaaccatgacagtttttgccccatatgtcctccttgctgacatgacctcgaacatggtaaactttccgtaggaaaaacggggcaagtactttcgagcggctacctcggcccccggtgggctgtccagccttgtgcggaccgaagccgggggattccttatgtttgcggcaatgatgccgctgcaccccctcatgccgtggtgtggtcctttccccgtgtgcggtgtggtgcgtcgttgactggtttgtggccccgagccttactctgaccggtaggagaacggtgtggggtctacggatagcccactcggctcccggtggaatgtccaacagggtagggttgatgagttggtccatcaggaccgtcccggtggctgcgtcaatgatcgatatttcgatgatgcgcccgtccaggtcggtggtttcggtgtcgaggatgactccgactccgggttctaggagttggggatccaatgggtggtcatcgtgtggctcctacaggg

SEQ ID NO: 105 - DNA, 17061 bp, Propionibacterium acnes; identical to SEQ ID NO: 103

SEQ ID NO: 106 - DNA, 2003 bp, Propionibacterium acnes
accagatcggccacatccgtcttggcccatctccagcccgccagacccagggaggccatcacctcatcgacgccgcgccgggtggtctcatcaaccccgtcaaacagctcgggccacctcgatgatgccgtccgtgaacgatccagattcatgacatgctcctcttcacagatgccgacgacgatcaggccgtggccgtggcaacggggtgacctgccggcgcggctcacgacgttgagccggaaccacacgagacgcaccagtgtgctgcgccgtcttgagtcgggcgctgtactgggccctggcgctgtggtgaacagcccgacgaagcaccgaccgccggctgtcctcatcgccagggcgaggcatggggcgcggcatggtgcgcccggtagcagcatccatgagggtgatccggtcagccaaaatgccgagccggttttcccacttccggggccacggcaccagcaggtcacgctgacagcccacgccgtggcgtcggcagtccacaacattttctcacggccaggatgcgagtgcagcagctccaccggaacaccagcatcacgcacccgccgcatcgtgacctcatcctcacgctgccgatcaccgtcaaccagatggtcagccacgatggtgttcacaccccatgactcatgcagttgcctggccaaggcgcccaacacctgctgacgcacctgtgacttgacgtcatcatcctccagatcctgtgtaccaaccatcacggaggccaacacatcactgcgttgctgaaccagggtgttgacgacgtcgacatcgtcgatacccatgggattgttggcgcgcgcggccacggcatgaaacgtgttggactgcaaattctcgaccagaccacgccgatagtcgttgaactgggaggtgtcggcaatgacaccggtcatgatgtaggccgacccctcggacaaggccctgtaggactcgtcgacgaacgccaccaaccccggccgccgccggtaaagtcgacctgcttcctcgtcagccagcaaccatgacagtttttgccccatatgtcctccttgctgacatgacctcgaacatggtaaactttccgtaggaaaaacggggcaagtactttcgagcggctacctcggcccccggtgggctgtccagccttgtgcggaccgaagccgggggattccttatgtttgcggcaatgatgccgctgcaccccctcatgccgtggtgtggtcctttccccgtgtgcggtgtggtgcgtcgttgactggtttgtggccccgagccttactctgaccggtaggagaacggtgtggggtctacggatagcccactcggctcccggtggaatgtccaacagggtagggttgatgagttggtccatcaggaccgtcccggtggctgcgtcaatgatcgatatttcgatgatgcgcccgtccaggtcggtggtttcggtgtcgaggatgactccgactccgggttctaggagttggggatccaatgggtggtcatcgtgtggctcctacagggagtgtctgggctggacagcggtgcaatacccgcgccatagcggttttttctgcgggggtgacccacagctggtatttcgttttgacggcgatttggcgggccacgtagtcgcatctgtaggccttgttagggggtagccaggtcgctgcatccctgtctcgtttggcctcattagcgggtccgtcgacagccagcaagttcaacgggtcgttggccagggcggtgcgttgcagcggtgagagtttttgcgcgccggtaatccacgcgttcccgagggctacgacgtggtcgatttggactgttgtcgaggtgtgccggccgcgccgccaggcgagtgtggacccggtgtaggggtcgtggagtcgcccggagacgaccacgcatcgtgatccgggtttcaggtgggcctcgaccaggtcgcgggcaagggcatcgttgcgggtgtcgcatccgttgtggccccaggggcgggtcaa

SEQ ID NO: 107 - DNA, 17045 bp, Propionibacterium acnes
gtgttccagtgcctcgcgggcgtgatgttcttcttcggcaccttcttgccacatgcttcgcgcttcagcctcgccatccaagcgaacctggactgtgaacgagtcctcatcgggtccgtcctcattccacgcggcaatgatcccacgggcctcgtctgcgacctgactcaacttcatcgcctgcccgacagccccgagagccggaatctcgaacacccagatattcgcctcagccgagacctcacgatgggcgatcacttcgtaggtcgtctcaccttctactgtcgtgtccattacttccactccttcggaattttcacgcctgctcgctccagctgtgccaggacaccaactgacgtcagctggtgtcctgctggtatcgatacgcgcccggctccgccggggcgtccccagatttcatggcttcccttggcgttccgcagacgggcccatccttgagaacggagcagcttgaggacgtccttagttttctgcggtttcacacatcatagtatagccccacttaacttgtaaactaagcccctgtttacattttagttggtgcatgtgatccctgctcttatgacgtcgcccgacctggcgccttagacatgcactgttcatcctcaaccacactcaccgtcacgggtccgaaggcgaggtctatcaccattcgcatcgatgaagttgaagcaggatcgtccgcatcacgcactgccgatccggacagacgccaccggccgtaccgactgtttacgatctgccaccgcagactgctgccataaccgctatcacctctgatagtacttttagtactatcagaggtgattcaagattctcctgtcgagcagccctacagtcacgaagtcctgcgatcgtcatcgcttaaggcagacggatggccatcggggaccactcgcaaagcaggggcgatcagcaacagtgatgtgccatgagcaagtactggtgcaccggctgtttactccgcccctagataaaccacgggtgcaggggtggacaccacaccatgaccgatgtggtgcccaccccatggctcacaggcaggccctatcgccgggagcactgctgcagatgaggctcagtaacctgccatgtctcacctggggccaaggtgccaagctccccacggaatctcaggcatcggaaaccagcagccgaacttccacagcatgagcgccctacgaaaaagcaggccgccgacggttctcaagaactcgccggcggcctgcatcgccactcgaactgtaaccgtggtccgaccccgtgcacaggtaagctccacactcccaccaggcatggccgaggcagtaccaagttgccgtggcccatcggcagatttggttaaattttgaaaagtcatatagactccttctgtaaatttttaaatctcataggactctcgccatcgccagccagcttcgacaggagtcccgatgtttcaccgagtgaaatatcggcaccgtttgagttgacctaaagctcaaaagatgctagaatccatcttacctcgttaggggcgttttgtcaaacgcccctatattgcgtgtcttcgcgcgtcgtagcgctgatgctgcgcctgtgtcgactatccgtttgtaagtacttcgatgacaccagcagtggctactcatgactggtgcgtgcgggtctaaagcagcagggaaaggaatcgcagtagaagccgcttgattcctatcacccctgatggtactatcagtactaacagagcagggcttactcgatgcgtgagaatcggggacatgctgagcctctcgtaggtcattggcctgctgggcgtcagtgtggcgcggttcgatccagtgaactctatcagctctgttagtactgtcagagttgatatattcgaccccaggaggagcccatgagttacatcgttcgcaccggaaatttggtcgacacccccgagctgcgtgagggagagcatggcccgtacacctacgctcgcgtcatcgtgtccgatcgcattcgccaggaggacggcagctacgtcaacgggccagcgatcgcctacgacgtcttggcgggtggcagccaagccgtgaatctggttgaagccgccaaggcgagcggcaacatccgcatcatgttcgcgggccgttaccgcgtcaccgagtggcggggtgagcagggcactcgtatccagcatgaggtccgagccgacgaagtgagcgtgagcctgctcggtcagagggtgaccgtggagcggcctcgaggtgacgtggcatccaaggagagcacgtcgttctgattgagtccgggggcacggtggtcgccgtggtaaaccgtgcccctgacagtactattgacactattggaggtatcagtgtgactgctcaaattttcgccttgtgcaaccagaagggtggcgtcggaaagtcgacatcgacgtttcatctggcccgtgccgcggtgttgcgtggccagcgtgtgcttgtcgtcgacaacgacccccagggcaacctgacgtctgtcgcggccgccgagcccgtgggggaggatcaggcggggctggccgatgtgctcagcgcgcgtgctccagagaccctccgcgatgtgatcgtgccgggaatctggtctggcctcgatgtcgtgccgacgtctggcatcacgctcggctgggtgcgtgacgaactcgtgatcgccggtgccggccgagaaggccggctgcgggaggccctggccggcgtcgaggacgactacgacgtgatcctgatcgactgtgctccatcgctcgatcagctcacgatcaacggcctggtggccgcccagggtgtcatcgtcgtgacgcactcgaagttgtggagcgccaacggcctcgcccagctgctcgacaccatcgacagcgtgcgcagctactacaacggcgcgctgcgcgtggcgggcatcatcgtcaaccagcacgaggagaacaccatcagcgggaaaacctggctcgacgagctgcatcaggctgccgagtcccggaagctgaccgtgcttgacccgccgatccccaagcgtgtcgtcatcgccgataccgtcgaggccgcgcgcggtctcgacgagtggggaagtgccgaggcggccgcgctcggccagttgtacgcccaccacctgacctgcatcgaaggagccctgtgatgacccgtccagccccccgaaagtcctcattgagcggatcaactccggtcgccccgccggctcagacggcgccggcaccgtctgccgcacctaccccccacaaggccgatgagtcacagacgagcagcaccacgaggaagtggcggcacaaggtgtcgttctaccaggacccggccgacaccgaccgggtgcgcggggcgatcctttacacgatgacgaccgagggcaaccggaacctgagccagttcgtcaacgatgccgtcatggccaaggtggtcgagctggaagtcaagtacaacgatggccagccattccccgctgtgggagcccgaggactaccccagggcggtgcagccgccgccggtgagtagaggaccatcgaccgtcgggggcttcaccatgcccccgaccctcggtcatcctgatcctcttgtcgatggtggtgacagtgggggattcacgcctcgttcagatcagaggaagtctcaccgcgtgattagtactatcaaatctgacagtactaacagagcagatagggttccctaggtcgagctgtatcacgccgacaaccagtgagccagtgatctacgggggggcgcaatatgcacccgatcggtagccgcgaaggcctcgccctgccccgatagtactatcaccactatcaatggtgctagtggtgagtttcttccattgatgacaacagcacagtgctgccgtctgtgtgcgggccaccagcccgcacacagttgccgtcgaggacgttgttcatgctctgtggtggccggtcctgagggcggctcgcaggatctcccggcgctcacggcgacgagcctggtagccaaggtctgcatgttcggcggcgagacgggctttgagggttgcggcttctgcacggcggtggagttggtcgtcgatgagttgggcgcgggccagacgccgcttatgggggttgtcgtgggtgagggggggcgtcgaggctgccgtcgtgggttagggccagggctgctcgttcggcgtcgtcgaggccgatgtggtggacggtcacgggtgcggtggtgacgtcgaggatgtccaggtggatgttgtggccgccgccgggggcttcggggaagtctggtgggctggcctggccggtgtcggggtcataccaggacaggccgatgatctcggcccagggtgggggcgggcagacggctcgcagaagggtgtgggccaggaacgtgttgcgggccatgatgcctccaagggtgaaaagcagtcgagtagcgatgacggcggggtagccgtctgctgggctgaggccgaccgggcccatgtcctcgatgctcttgtgctgcggccataccccaaagctaccaaacagtctttttaatctcaaagatacaaacagtgcttgacatattatctgcagcgaaagatactttcatcatggtggctgatcatgattacgcgactcctgacgatgagtggatgacacctcctcaggtggcccgtgtgattccgaacaccactgctcaggctgtccggcgctgggctgaggagggtcagcttcctggggcgtttcgtactccttctgggcgttggcatattccgtggtcggctgtggtgggcatcatggggtttgatccgcgtgagtccgcatcaccgagtgatcgtcaccagagctgacagagtcgtcgatgagctttcgagtgcagagctgatggcacgacggtctggatacttgtggagatgagagacgactacatccagtcatggtcggggtacaccgaggggcagattcagcagtgctggcacgatgaggttgcccctgccattgactcgctcatggagcaggtaaggtctgttgccgagactcctgtgccgccgggttcgagattttacggcgatgagcagtgggccaagccttttcatccgtctactgcgatctgcggttcaatgggtccgccagcgatcacttgcacgcgctgaagctcctcgtctgggaagcgaacgtccaccatgtctatgcgccgtacacccttgctcgtgcatctattgaggcatcgtctactgctgtgtggctgttgagcacgaagacgcgcggagaacgtgtgctgcgagccttgcgatggtacgcgcaggattgtcacgactcgtgcaggttcatggatgatgagcagtatcgtgaccacctattgcggcgcattgaggggactgtcgctgcgggaaatctcgactcgcgcgctgctaggaaacggtaccgtgcaaccgatgttgtcgatgaggctgatcagctggttcccggaactctgagggcgtggcgagctttttctggtatggcccattcccgtatgtgggcatccagggggctgctcgacatggaagtgctgtccagtggccaaggaatggttacggcgaaggtgacgagcggatcggcccaaatcctttgggccgtcgtggcagctctgaatgttgctctcagtgccgctcgcttgtggcgtgattcgatgtgctcaccgtttgctgttgcccagtcggtagacgcgatgccagaggcgtttcgccgccctgtttagggtctgatcggggtagtgggtgttcacggggtcccaggttggccatggggcggcttggtgatgtgagttgggttgtgtggcagcctgggtgttgggtgtggcttcgttggccacgaaggcatgctcttccttgtgctgggacttgagtccccagtgctctcccctttgctagtggggggtggggtccccggaggtaggtcctccggggactttttctatgtctgtccgtgccccaggatttcgtatctaggcagtaccaattttgggttagttggaggtttctttggtaatggacagggtgagggtgatgaagaggtggccgtccttggtggcagaaattttctcgaacttcagctgaatgttgttatcagccactatctgttgggcggtgaggtgctcggagagcttctggaatccttcgcggatccacaggttgtaggggttggtgaccgagaccgaagggtatgggtcgaccttcagcgtcaggactggctggtctgggttgagggagttgatcttcaccagtttggggtaccggtcgcactcatgtgtctcttgtgttgggggccagcagtcgggggcccattcctcccagtggtcacgcatctcacgaagtactttcctgcatctcagcctctgcaggagctcgcgcgccaccgatgggagggctgccatgatgagggcaaggactgcgaacccgatgatgtaattgaccgtgtccctcgtcacgccgttcttgccgaggattccgatggcgaacgcgatgacgacaccgcccaggcacaggtgcatggggtcatgctgtgatggtttttcttcttcagcgactggtggggctatagtcatgtgtgccccttagtactaagtgatactggtgggttgcttttccccggtggccgtgtgcaagacggccaccggggttttccttcatgttcctgattttatctgcccggtgtggcgttttcatctttgtgtgggtggttcgcctggggtcttggagtgtggtgacgcggtgatggtcacggtgacggtgactgtggcgcgtggcgggtgaggtggttctttcctggtctggtgtgtggcccaggtgagtgtggtgatgagggccagggtgaggatgatgaccagggtggggagtagtttgtctggccggtgtcgccgggcttggtggcgcggcatgtttttccagggtgtgtctccgaacaggtcgtcgtcggaggggtcgtcgtggttcatagggtggccttggcgatggtggtgggcgagtttggtccaggtgatggtgccgtcggaggcgatgtggcggtcggcgggcagggtgtggacggtccatccggcgtcggtgagggcggtggtgaaggatttcttgatggatcgtttgggtaggtcgatgggggcgtgggtgccgacccagatgcaccggtttttgaggtgggtggcgccgaggtggttcatgtcgcggaccatgttttgggtgagtgtgagggtgtcggggtcccattggacggggatgatgatgtggtctgcgatggtgatggcgtgttgccaggcggcgtcgaggtcgttgtttccggtgtcgaggatgatgacgtggaagcggcttcttagggcggtgatgatgcggtcgaggtcgtcggcggtggggggtgtgatgaggctgttgtggttgtcggtgatggtgggtaggcatgtgatggtggcccagccttctggttgccaggagatgtaggggtcgaggtcgcggggttgggaggcgaatcctgggtgacgggctgcgcgggcgaggtcgatgacggtgttgtcggtgtggcggggtgcgcgggtggagagggtgccgcgtgggttgatttccacgacgacgatgtcgtcgtgtcctgctgtggtggcgagggcttgggcaaggatgacggccagcggggttttgccggtgccgcctttgaggttggcgagggtgatgatgtggtcggtgagttgggcgggtgcggcggtgtggtgagggttggcggtgaggttggcgatggtgaacagggcatcgagatcgtcggtggtgttctgctcggtgggttgggggtcgccggagatgatcgggtcggcgcggcgcggctgccatgccggcctcaccactgtcacgaccaccacgggtctgctggcgctgtgtgggtgtcgtcggcgatgactcacgatcggcagtctcaccatcgtctcggtgatgctcggctagcgctggacccggtcaagttcgggccggctcacccagtggtgatgactcggtcacagaaccgctgccggtcgttatctcggacgtctcgactcctccagtcctgatgggcgttggagccacctacacctactctcagaacgaccccgacctcgtgtggggcgggggcagatgtcacttgggccaatcgagagcccaggtgatggggaaagcaggggtgtgatatctgtcctggaaaactgggcagctgctaccgtggattgacggatctccacgaaagaagggaatgcgaccatgcagatcaccgtcaagaccatcaaagatcatcgggttcgcactgtccagaccgccatgagcagcgccttggggattggttcccaggtagacatgctcgcccccggcggttccaccagctcgagttccggttcatgctgctcgtgctcgacctgcgcggtagtggcgcagcctcaagactgaacggctggtcagccccaggggcgtggcgctcatcgcgtcacgccccttctattcgctggacagggtgcgcgagctgaggaacatcgcggtgtgtgcgatgacgaggggcaggagcaagtctgtgcgggttgccaagtagccctgcgcgatggccatcacgctggccccgacggcggcgaagacacctccgatacgtcgcttcatgccgccgaattgcatcaggacgaataggactcccgcggtccacatccctccgggcatgcatctgggaaagatgaaccggaagatgatctcttcacaggagagctggagtactagcagcgtagcccccacggggagactcacctctactgacagacggatcgtcttcatccacccacccgagctggcatcgaccatttcggtggccatgcgcgaccggtggcctcgtgcctctcgctgcgtgtcgatccagccgagcagtccgtggacgctctccgctaggactcctgacgcgacagtctcaccaattcctaagcccacggcgaggaccgcgacgcccccctgcacggcaggctgtgtgacttggtggtcccaccaacccgccggcaggaccatgcgtgcgaggctgcacacgagcaggaggtggagggtcacgacgagcgacatctggaataccgcttgccgttcggcgatggtggcgttgggaaagagcggtaggccggcacgggcagcggcgctcgacagcttccgcaagagcggtttggagacgaagtagtaggcgacgtacagcgccagcgctgtcgcgatgatgatcatcggtctgccaccgagctgacccgccgatagccgtttctgttccaccaatactggctgttgtagatcaggtggcccagaacacaggcccagatcccccagaagatgaacaggatagtccccaaggcggcgagcgggatcttggagaggacctgtccccgtccgaacaccgagtggccgcaagcaaacaagagtgctcccacagcggtgagcgcgagccaggccggggttgctcgcagactgatcaccgggaccccgacccggaagccgacctcttctcctacagcgatgactagcaactgccacagcggcatgttctgaacggagcgcgcgactcgggctcgagtcacccacacgggctgttgagcgctcacatcaccactcaggtaccccggtgaggcacttcgcttagtactggggcccgatgtgcgagcattcgtgatgtgtcgcaggatccggttgtcaagccaagaggccagcagggctccggcgacagtgacgggtagcccgatcagcacgaggccccagccatgcggtgccgagaggtttctggccggcgtgcacgcgaggcaggcaagtgccaacactgccagcactacgacgtagatggtcgcataattcgacttgcgggtgacgttgccgaccatcttggccaaagtcgctggggaccagctgatgagtgcgatggtggtcagcaggaagcaggaccagacagacatccggcgcactcaggggtatgggtgcggctgtgggttttggaaaccgccatatgcggcgtagcgggggtgtgcccgcatgggtgcgctgggcagtgacagggcgagcagcccaggcgcccagagcctgacacagtgcagtcccagcccctggatctctatggtggtgaaatcttcgatgtacaggggtgacacacaggtgatgctgttgaccacgctctttaccagttccgcccccgtgtgggtgtcgtcaggtggcaggtcttcggcttgggcaatggtgcccgcgtcgaatttcgccacaactgattgcgcggcctgatagttcctcgcgtagtaggagacgttcgagtcgaggtcaagcatgtcctccgtggacatactggacgcgtcggcctcggcgtcgaaagacgtccataccgcgagcatccgaaccccgctgcactcgagaaacgccttgtacatggctgcttccagacccgcgtctgcacctaggccgacggcgacgaggggaagttggttgccactaccgaccatcatgcatgccacggtgaaatgcttgagcccgggagtcggaagccagtagaaacgcagttcgtggcttcggcccgctgcacgttccacgagccgctggatgcgctggaggcggggtccttcgacgcggatgcgcacaggtgacgaggctccataccacaggcccatcgcggcatctacctggatcaattcataagccgcggacagcgttgcggcgacgcgtgaagtgtggacggcggtgccggtcgtcacggccgttcccagccacggctcaccgtcgtgccgacgggggttgtaacccaggtaaaagaactgcgccgggatccactcctgccgggaggtcccgacacggggagtcttgacccatgtcatgggcaagtcgtcgcgataggtgtcgaacgcacctccagccactcgttgcgcgaagccgaatgcgcccagatcgagaacttcgtcctcggtccgggcgaggagttcctgacgagtcgcccagcgccgttcgaagggactatggagaatcccggtacccgcgcagtagcgctcgacggcctccgcgtagaccttgatctctgcctcaaactcgttcagccccaccccaccgatgtggtagctacccggcttggggtcgggccggtcaagcagtgcgtgcatccccgtgagttccccaccgttcacccgcacgcgggggccgagcgcggggtgcagcgagtagccgacggaagtcaccagcccgcatagcgggctgtaggtgcgccgcctgagccgggctgcggtctcgacggggtcgctatcctggcgaagcttcatcgctcgccccctgccgccagccactcacggatgtcgtagtacaggtccggagcggtttcaacctgcgctggtgcatcaaaacgggacataggtaggacgtcgttgtaggcgatctccatcgtcggtatgtagaccgacaacactttgttgcgcgtcgtgttgaggccgttgcgggcgatgctgacagcctcatgcgcgacgtgcgcggccaagatcgcgcgcaccgacgctgccacggccggcgctccggcccttacgcggtcggcagcggccacccgcatccaggacaggtagctctgccgttcgcgcaggttcatcgcgacccgctgctcgaaggtccggtaggacgaggtcgcaccagggacgacgtagggacccacgtacaaggccggcccgtctacagctgcgtggagccacgacaggtgggcgcgtcgggcgaacaggtcaagggcgcgcagcatagccgggttgttctgcgccagcgctaccacaaggagtggctgcaggtccggcgccgaacccagcaacgccaacatctgggaggcctcctgctccatgtgcaactcgtcggccgactgctcaagccgcaggcctgcgaagagggtggctgatggctgcgtgtcgtcagcgaggacggtagcctgcagcccctctccctcgagaatctgctggatatcgccggcgaggagcgcgtcgtcgctgaatacccacaccgggcgcgtctctctacctccatccatcttgtcctcaacgttttcgaccagcgcaccgatcgatgctaggtgggccatcacgtcgtcaagggccgcgcgggtcaatccgggcacccgggacacgatctcgggcggctgcagtccttggctcaacaagtccaaggccggccacagggtcccggtggcgtcgtcgtcctccagcgttgtgctctcggcgttccagacgcctcgacggaactccaccctgtccatcgagtaaggcaccatcatgaggcccggtgaaatgtggttggtcactttggctcctgtacagcctaggcttggacgcccacggtcatggtgtgggtcgcggtttggaaaatcccgtcgaggttgagtgcctgattgagttcgtcctcgtagaagcttgaggactcgactgaggcaagaccgagccccgtgcagaccaagttgatctgttgtgcgatcgccccgacttcttgaagggcgaacctcaaacccctggctccgtacttccgcatcgccctccacggcgagatgacgaacaccaagtgcactccggccgcatccgattgctccacggccggctcgccggccatcgaattcctcacgccgcgacagccctcttcaccggtcacgggcaccagtcgatcgatgaccggcgagtagcggtagacgccgcgactcaagccggacacccgttgtgcggacatgaagatagacacgggatacagccctccaccagacgggacagcgcgtacattataccgcacgatatcaccgctcgaacgtgggacatccacgtgccccgtcacaccggcagcacctctcagaaacgcagctacgtcacgcaggtctagggattcgccggtgtagttccgtccgctgcgccggcgggcgatcacttgctcgaggggtgcgcgcaccctgctggacctgggaagttcgatcacatcggcagcgaacgtgtcgcgatccatctgtccgtacgtaacgatcatggggtcaacgaaatagtcgccgaccgagacgttgaactccatatccccccgggcgatgcgcgaggcgagcaagaagtctgcagctgcgttagacagccccggcccatcagtgttgtcgcagcggaactcgtgggtccgaaaccccacaccttccgtgcccgggctctgcgctcgatacgacgtgatcgcagaactagccttccttaaaccgcccggagtagctaccatgaccgtcccctctgaggtctcccgaacacttgcgacaatagcagcatgtgggggcagccgccagaggcgggcatccttgtctcgacaaccattgacctccggattcgatatgtgcataatcatagtcgtgccaacacgaaacgtgtacgtctcggaagacgacctagacctgttcgccgaagccaccgagatcgctggaggcctgtccgcagcggtgttggaggccttgcgcagctacgtagacaggcaccatcgcgcggccggcggattcgacgagatcgagctggagctgcagaacgacggtatcgaccaccgtgtcaccttcatgggtcgccgcctgatacacatccgccgtccagatcccgagggaacccgcatagacactgtctacttgaccgccaaacaccaattcgccgttgccaccaaaatccaacgacggctgccagactggacgaccggccacgagcacatctggtccgacccggagacctggaatcgggagttctggatcgcaggtgacaagacgatggccgtgtatcccagccttgacaaactccgcgaagctgaccccaatgtggccgaacgcgccgaggccgcggtcaaaatcccgccgttcgaggtcctggacatctgatgacagaatcatcatcttcccggcggcaattggcaatgccggtgctgtcagtcacggatctagccaagaaatacgtggttcatggcggctacgaggtcccggcactcaacggtgtctcgtttgacctgcacccgggagagatgctgggtttgttcgggccaaacggtgctggaaagacgacgctggtcaggatcatcgcgggcctcttatcggcagattctggagacgtccactggggatcggatcaaggtcgggccaggttaggctacgtgtcccaaaagggtggactgcagtacgggctcacgtgccgggaagagatggtcttccacgcacaatgcttcggccagtccgccaagcaggcccggactagcgtcgacgaggtcgccgcgatgctgcactgcgattacctgatggagtgggacgtcggaaggctctccggtgggcaacgccgaatcatcgaggtagggctagcactcgtcaatcaaccatcggtcgtcctgctcgacgagcccaccctgggcctggaccccgcaacacgcctgtcgttgtggcaaacggtaaagtcggcacgccgtgagaccggtgctgccttcctcgtcaccacccactacattgacgaggtggccgagcacctgtccaacgtcagcgtgatcaaccacggaaccgtcgtcgccaacggctcgccagcgcacatccgagaaatgttcgcgaccggggaagtaacgctcggcgtggccgaggatacggtggacagtgcggtggacgtgttggctgggaccgcgttcgaggcgcaccccaccgaaaccgtcccggggatcgtggtcaggtccaggcatcccgacgtggacgcggccaagatcatcaccatcctggctggtcatggcatctcggtggactccatatccgtacgcgaggcgaccttggaagaggcgtttctcacgatcacaggcagtcgagacccggagaggcaaatcccatgaacacttgcttcaggcgatatgcggcgatgtcgctgagagcgcggcgtgatttggccctgacattcatccagcccctcgtctacctagccctcttcggaccgctcttcgtcacgacgatgaagatgtcgcagagagctaccgccgctacgggttactccctatacatcacgggcctgtccatccaaatggccatgacgatcggtgccttcgcggggctaaccatcatcctcgaataccgactcggcatcctcgaacggatctggagcacccccctcacggggagcaagatgatggcggggcgaatcgcgcgcgacgtcgttatgatgatgatgccgatactggtcgtcttcatcatcggcctggtgctgggaacacgccccagcccactgggcctggcgacctacttcgtgacagtgctcggcacaggagccacgttcgccggggtctcctacgcggtggcactcagaacgaagagcgaggcagcgctatccgcgatcttcaacctcatcctgctacccatcctcctgctgtcggggatcatgctgcccatgtcgttcgcaccacactggatcgccaccgctgcccacgtgaacccgttgtggtacctggtgcaaggcgcgcggaaccagttcagcgttctagggctcgtggcggcggccccatggagttgggctgtggccatcgtcatgtcagccgctgccttcggctgggcaagccacgaattcaacaagaggcgctgacacaaagaatggtgccgggaacccaggtccccggcaccaccgagtgcactcgcgacgtcaacgcaccgttgcggtcactgcgcaggtcgagcacgaggacgacgagcccgcgctgctgcaggtcgagccgccaggcgcgagcaggtcgacgttagcgtcggcgccgccgaagacggacgtgacggccggctgagaggtgcggatgcggtgctccagcgaggaggtggtggtgagtttcatgggaggtgctcctaggagtgagacgagaacaaaccctagcgataggttagcagtccgcaaccgactccgggaatagtagaagcgcgcatccgtagcggaagaccttagcctgattacagtgaccctgttcgcgtctcaacattattccacacccccgagcagcgaacgacaccgcgatgatgatccgtcgcctctccaccgaagaactccgcgcccacatcgcaccgggccgccgtcccgtgcatcagacctgccgtcaacgtcggccatgaagctgggaaggtggctctcgtctaggagcagacgcgggacgcctcctccaggttgggccggggaagtgtccggttcttgatgtaggtggcggtccctattgatgggcgttgaccgtgggaatgcggtcggcgaagggggtggcgaacccgttgagcgcaggcttccagcgcatgcatcaacgctgtctgccggccaccggcaagcctcacccgcccgtcatggccatcatcgaggtgccggtgaatcctcgacacatgatcccaactcccccggaggggcttccggggctgttcagccaccagatcagccaggcggcgagcccgactctgccacccggaccctgcagagcgtgcctgctgccgtcgtgtcgtgtcgggccagtgggccaccagatcggccacatccgtcttggcccatctccagcccgccagacccagggaggccatcacctcatcgacgccgcgccgggtggtctcatcaaccccgtcaaacagctcgggccacctcgatgatgccgtccgtgaacgatccagattcatgacatgctcctcttcacagatgccgacgacgatcaggccgtggccgtggcaacggggtgacctgccggcgcggctcacgacgttgagccggaaccacacgagacgcaccagtgtgctgcgccgtcttgagtcgggcgctgtactgggccctggcgctgtggtgaacagcccgacgaagcaccgaccgccggctgtcctcatcgccagggcgaggcatggggcgcggcatggtgcgcccggtagcagcatccatgagggtgatccggtcagccaaaatgccgagccggttttcccacttccggggccacggcaccagcaggtcacgctgacagcccacgccgtggcgtcggcagtccacaacattttctcacggccaggatgcgagtgcagcagctccaccggaacaccagcatcacgcacccgccgcatc

SEQ ID NO: 108 - DNA, 582 bp, Propionibacterium acnes
accagatcggccacatccgtcttggcccatctccagcccgccagacccagggaggccatcacctcatcgacgccgcgccgggtggtctcatcaaccccgtcaaacagctcgggccacctcgatgatgccgtccgtgaacgatccagattcatgacatgctcctcttcacagatgccgacgacgatcaggccgtggccgtggcaacggggtgacctgccggcgcggctcacgacgttgagccggaaccacacgagacgcaccagtgtgctgcgccgtcttgagtcgggcgctgtactgggccctggcgctgtggtgaacagcccgacgaagcaccgaccgccggctgtcctcatcgccagggcgaggcatggggcgcggcatggtgcgcccggtagcagcatccatgagggtgatccggtcagccaaaatgccgagccggttttcccacttccggggccacggcaccagcaggtcacgctgacagcccacgccgtggcgtcggcagtccacaacattttctcacggccaggatgcgagtgcagcagctccaccggaacaccagcatcacgcacccgccgcatc

SEQ ID NO: 109 - DNA, 16496 bp, Propionibacterium acnes
gtgttccagtgcctcgcgggcgtgatgttcttcttcggcaccttcttgccacatgcttcgcgcttcagcctcgccatccaagcgaacctggactgtgaacgagtcctcatcgggtccgtcctcattccacgcggcaatgatcccacgggcctcgtctgcgacctgactcaacttcatcgcctgcccgacagccccgagagccggaatctcgaacacccagatattcgcctcagccgagacctcacgatgggcgatcacttcgtaggtcgtctcaccttctactgtcgtgtccattacttccactccttcggaattttcacgcctgctcgctccagctgtgccaggacaccaactgacgtcagctggtgtcctgctggtatcgatacgcgcccggctccgccggggcgtccccagatttcatggcttcccttggcgttccgcagacgggcccatccttgagaacggagcagcttgaggacgtccttagttttctgcggtttcacacatcatagtatagccccacttaacttgtaaactaagcccctgtttacattttagttggtgcatgtgatccctgctcttatgacgtcgcccgacctggcgccttagacatgcactgttcatcctcaaccacactcaccgtcacgggtccgaaggcgaggtctatcaccattcgcatcgatgaagttgaagcaggatcgtccgcatcacgcactgccgatccggacagacgccaccggccgtaccgactgtttacgatctgccaccgcagactgctgccataaccgctatcacctctgatagtacgtttagtactatcagaggtgattcaagattctcctgtcgagcagccctacagtcacgaagtcctgcgatcgtcatcgcttaaggcagacggatggccatcggggaccactcgcaaagcaggggcgatcagcaacagtgatgtgccatgagcaagtactggtgcaccggctgtttactccgcccctagataaaccacgggtgcaggggtggacaccacaccatgaccgatgtggtgcccaccccatggctcacaggcaggccctatcgccgggagcactgctgcagatgaggctcagtaacctgccatgtctcacctggggccaaggtgccaagctccccacggaatctcaggcatcggaaaccagcagccgaacttccacagcatgagcgccctacgaaaaagcaggccgccgacggttctcaagaactcgccggcggcctgcatcgccactcgaactgtaaccgtggtccgaccccgtgcacaggtaagctccacactcccaccaggcatggccgaggcagtaccaagttgccgtggcccatcggcagatttggttaaattttgaaaagtcatatagactccttctgtaaatttttaaatctcataggactctcgccatcgccagccagcttcgacaggagtcccgatgtttcaccgagtgaaatatcggcaccgtttgagttgacctaaagctcaaaagatgctagaatccatcttacctcgttaggggcgttttgtcaaacgcccctatattgcgtgtcttcgcgcgtcgtagcgctgatgctgcgcctgtgtcgactatccgtttgtaagtactttcgatgacaccagcagtggctactcatgactggtgcgtgcgggtctaaagcagcagggaaaggaatcgcagtagaagccgcttgattcctatcacccctgatggtactatcagtactaacagagcagggcttactcgatgcgtgagaatcggggacatgctgagcctctcgtaggtcattggcctgctgggcgtcagtgtggcgcggttcgatccagtgaactctatcagctctgttagtactgtcagagttgatatattcgaccccaggaggagcccatgagttacatcgttcgcaccggaaatttggtcgacacccccgagctgcgtgagggagagcatggcccgtacacctacgctcgcgtcatcgtgtccgatcgcattcgccaggaggacggcagctacgtcaacgggccagcgatcgcctacgacgtcttggcgggtggcagccaagccgtgaatctggttgaagccgccaaggcgagcggcaacatccgcatcatgttcgcgggccgttaccgcgtcaccgagtggcggggtgagcagggcactcgtatccagcatgaggtccgagccgacgaagtgagcgtgagcctgctcggtcagagggtgaccgtggagcggcctcgaggtgacgtggcatccaaggagagcacgtcgttctgattgagtccgggggcacggtggtcgccgtggtaaaccgtgcccctgacagtactattgacactattggaggtatcagtgtgactgctcaaattttcgccttgtgcaaccagaagggtggcgtcggaaagtcgacatcgacgtttcatctggcccgtgccgcggtgttgcgtggccagcgtgtgcttgtcgtcgacaacgacccccagggcaacctgacgtctgtcgcggccgccgagcccgtgggggaggatcaggcggggctggccgatgtgctcagcgcgcgtgctccagagaccctccgcgatgtgatcgtgccgggaatctggtctggcctcgatgtcgtgccgacgtctggcatcacgctcggctgggtgcgtgacgaactcgtgatcgccggtgccggccgagaaggccggctgcgggaggccctggccggcgtcgaggacgactacgacgtgatcctgatcgactgtgctccatcgctcgatcagctcacgatcaacggcctggtggccgcccagggtgtcatcgtcgtgacgcactcgaagttgtggagcgccaacggcctcgccccgctgctcgacaccatcgacagcgtgcgcagctactacaacggcgcgctgcgcgtggcgggcatcatcgtcaaccagcacgaggagaacaccatcagcgggaaaacctggctcgacgagctgcatcaggctgccgagtcccggaagctgaccgtgcttgacccgccgatccccaagcgtgtcgtcatcgccgataccgtcgaggccgcgcgcggtctcgacgagtggggaagtgccgaggcggccgcgctcggccagttgtacgcccaccacctgacctgcatcgaaggagccctgtgatgacccgtccagccccccgaaagtcctcattgagcggatcaactccggtcgccccgccggctcagacggcgccggcaccgtctgccgcacctaccccccacaaggccgatgagtcacagacgagcagcaccacgaggaagtggcggcacaaggtgtcgttctaccaggacccggccgacaccgaccgggtgcgcggggcgatcctttacacgatgacgaccgagggcaaccggaacctgagccagttcgtcaacgatgccgtcatggccaaggtggtcgagctggaagtcaagtacaacgatggccagccattccccgctgtgggagcccgaggactaccccagggcggtgcagccgccgccggtgagtagaggaccatcgaccgtcgggggcttcaccatgcccccgaccctcggtcatcctgatcctcttgtcgatggtggtgacagtgggggattcacgcctcgttcagatcagaggaagtctcaccgcgtgattagtactatcaaatctgacagtactaacagagcagatagggttccctaggtcgagctgtatcacgccgacaaccagtgagccagtgatctacgaggggcgcaatatgcacccgatcggtagccgcgaaggcctcgccctgccccgatagtactatcaccactatcaatggtgctagtggtgagtttcttccattgatgacaacagcacagtgctgccgtctgtgtgcgggccaccagcccgcacacagttgccgtcgaggacgttgttcatgctctgtggtggccggtcctgagggcggctcgcaggatctcccggcgctcacggcgacgagcctggtagccaaggtctgcatgttcggcggcgagacgggctttgagggttgcggcttctgcacggcggtggagttggtcgtcgatgagttgggcgcgggccagacgccgcttatgggggttgtcgtgggtgaggggggcgtcgaggctgccgtcgtgggttagggccagggctgctcgttcggcgtcgtcgaggccgatgtggtggacggtcacgggtgcggtggtgacgtcgaggatgtccaggtggatgttgtggccgccgccgggggcttcggggaagtctggtgggctggcctggccggtgtcggggtcataccaggacaggccgatgatctcggcccagggtgggggcgggcagacggctcgcagaagggtgtgggccaggaacgtgttgcgggccatgatgcctccaagggtgaaaagcagtcgagtagcgatgacggcggggtagccgtctgctgggctgaggccgaccgggcccatgtcctcgatgctcttgtgctgcggccataccccaaagctaccaaacagtctttttaatctcaaagatacaaacagtgcttgacatattatctgcagcgaaagatactttcatcatggtggctgatcatgattacgcgactcctgacgatgagtggatgacacctcctcaggtggcccgtgtgattccgaacaccactgctcaggctgtccggcgctgggctgaggagggtcagcttcctggggcgtttcgtactccttctgggcgttggcatattccgtggtcggctgtggtgggcatcatggggtttgatccgcgtgagtccgcatcaccgagtgatcgtcaccagagctgacagagtcgtcgatgagctttcgagtgcagagctgatggcacgacggtctggatacttgtggagatgagagacgaccacatccagtcatggtcggggtacaccgaggggcagattcagcagtgctggcacgatgaggttgcccctgccattgactcgctcatggagcaggtaaggtctgttgccgagactcctgtgccgccgggttcgagattttacggcgatgagcagtgggccaagccttttcatccgtctactgcgatctgcggttcaatgggtccgccagcgatcacttgcacgcgctgaagctcctcgtctgggaagcgaacgtccaccatgtctatgcgccgtacacccttgctcgtgcatctattgaggcatcgtctactgctgtgtggctgttgagcacgaagacgcgcggagaacgtgtgctgcgagccttgcgatggtacgcgcaggattgtcacgactcgtgcaggttcatggatgatgagcagtatcgtgaccacctattgcggcgcattgaggggactgtcgctgcgggaaatctcgactcgcgcgctgctaggaaacggtaccgtgcaaccgatgttgtcgatgaggctgatcagctggttcccggaactctgagggcgtggcgagctttttctggtatggcccattcccgtatgtgggcatccagggggctgctcgacatggaagtgctgtccagtggccaaggaatggttacggcgaaggtgacgagcggatcggcccaaatcctttgggccgtcgtggcagctctgaatgttgctctcagtgccgctcgcttgtggcgtgattcgatgtgctcaccgtttgctgttgcccagtcggtagacgcgatgccagaggcgtttcgccgccctgtttagggtctgatcggggtagtgggtgttcacggggtcccaggttggccatggggcggcttggtgatgtgagttgggttgtgtggcagcctgggtgttgggtgtggcttcgttggccacgaaggcatgctcttccttgtgctgggacttgagtccccagtgctctcccctttgctagtggggggtggggtccccggaggtaggtcctccggggactttttctatgtctgtccgtgccccaggatttcgtatctaggcagtaccaattttgggttagttggaggtttctttggtaatggacagggtgagggtgatgaagaggtggccgtccttggtggcagaaattttctcgaacttcagctgaatgttgttatcagccactatctgttgggcggtgaggtgctcggagagcttctggaatccttcgcggatccacaggttgtaggggttggtgaccgagaccgaagggtatgggtcgaccttcagcgtcaggactggctggtctgggttgagggagttgatcttcaccagtttggggtaccggtcgcactcatgtgtctcttgtgttgggggccagcagtcgggggcccattcctcccagtggtcacgcatctcacgaagtactttcctgcatctcagcctctgcaggagctcgcgcgccaccgatgggagggctgccatgatgagggcaaggactgcgaacccgatgatgtaattgaccgtgtccctcgtcacgccgttcttgccgaggattccgatggcgaacgcgatgacgacaccgcccaggcacaggtgcatggggtcatgctgtgatggtttttcttcttcagcgactggtggggctatagtcatgtgtgccccttagtactaagtgatactggtgggttgcttttccccggtggccgtgtgcaagacggccaccggggttttccttcatgttcctgattttatctgcccggtgtggcgttttcatctttgtgtgggtggttcgcctggggtcttggagtgtggtgacgcggtgatggtcacggtgacggtgactgtggcgcgtggcgggtgaggtggttctttcctggtctggtgtgtggcccaggtgagtgtggtgatgagggccagggtgaggatgatgaccagggtggggagtagtttgtctggccggtgtcgccgggcttggtggcgcggcatgtttttccagggtgtgtctccgaacaggtcgtcgtcggaggggtcgtcgtggttcatagggtggccttggcgatggtggtgggcgagtttggtccaggtgatggtgccgtcggaggcgatgtggcggtcggcgggcagggtgtggacggtccatccggcgtcggtgagggcggtggtgaaggatttcttgatggatcgtttgggtaggtcgatgggggcgtgggtgccgacccagatgcaccggtttttgaggtgggtggcgccgaggtggttcatgtcgcggaccatgttttgggtgagtgtgagggtgtcggggtcccattggacggggatgatgatgtggtctgcgatggtgatggcgtgttgccaggcggcgtcgaggtcgttgtttccggtgtcgaggatgatgacgtggaagcggcttcttagggcggtgatgatgcggtcgaggtcgtcggcggtggggggtgtgatgaggctgttgtggttgtcggtgatggtgggtaggcatgtgatggtggcccagccttctggttgccaggagatgtaggggccgaggtcgcggggttgggaggcgaatcctgggtgacgggctgcgcgggcgaggtcgatgacggtgttgtcggtgtggcggggtgcgcgggtggagagggtgccgcgtgggttgatttccacgacgacgatgtcgtcgtgtcctgctgtggtggcgagggcttgggcaaggatgacggccagcggggttttgccggtgccgcctttgaggttggcgagggtgatgatgtggtcggtgagttgggcgggtgcggcggtgtggtgagggttggcggtgaggttggcgatggtgaacagggcatcgagatcgtcggtggtgttctgctcggtgggttgggggtcgccggagatgatcgggtcggcgcggcgcggctgccatgccggcctcaccactgtcacgaccaccacgggtctgctggcgctgtgtgggtgtcgtcggcgatgactcacgatcggcagtctcaccatcgtctcggtgatgctcggctagcgctggacccggtcaagttcgggccggctcacccagtggtgatgactcggtcacagaaccgctgccggtcgttatctcggacgtctcgactcctccagtcctgatgggcgttggagccacctacacctactctcagaacgaccccgacctcgtgtggggcgggggcagatgtcacttgggccaatcgagagcccaggtgatggggaaagcaggggtgtgatatctgtcctggaaaactgggcagctgctaccgtggattgacggatctccacgaaagaagggaatgcgaccatgcagatcaccgtcaagaccatcaaagatcatcgggttcgcactgtccagaccgccatgagcagcgccttggggattggttcccaggtagacatgctcgcccccggcggttccaccagctcgagttccggttcatgctgctcgtgctcgacctgcgcggtagtggcgcagcctcaagactgaacggctggtcagccccaggggcgtggcgctcatcgcgtcacgccccttctattcgctggacagggtgcgcgagctgaggaacatcgcggtgtgtgcgatgacgaggggcaggagcaagtctgtgcgggttgccaagtagccctgcgcgatggccatcacgctggccccgacggcggcgaagacacctccgatacgtcgcttcatgccgccgaattgcatcaggacgaataggactcccgcggtccacatccctccgggcatgcatctgggaaagatgaaccggaagatgatctcttcacaggagagctggagtactagcagcgtagcccccacggggagactcacctctactgacagacggatcgtcttcatccacccacccgagctggcatcgaccatttcggtggccatgcgcgaccggtggcctcgtgcctctcgctgcgtgtcgatccagccgagcagtccgtggacgctctccgctaggactcctgacgcgacagtctcaccaattcctaagcccacggcgaggaccgcgacgcccccctgcacggcaggctgtgtgacttggtggtcccaccaacccgccggcaggaccatgcgtgcgaggctgcacacgagcaggaggtggagggtcacgacgagcgacatctggaataccgcttgccgttcggcgatggtggcgttgggaaagagcggtaggccggcacgggcagcggcgctcgacagcttccgcaagagcggtttggagacgaagtagtaggcgacgtacagcgccagcgctgtcgcgatgatgatcatcggtctgccaccgagctgacccgccgatagccgtttctgttccaccaatactggctgttgtagatcaggtggcccagaacacaggcccagatcccccagaagatgaacaggatagtccccaaggcggcgagcgggatcttggagaggacctgtccccgtccgaacaccgagtggccgcaagcaaacaagagtgctcccacagcggtgagcgcgagccaggccggggttgctcgcagactgatcaccgggaccccgacccggaagccgacctcttctcctacagcgatgactagcaactgccacagcggcatgttctgaacggagcgcgcgactcgggctcgagtcacccacacgggctgttgagcgctcacatcaccactcaggtaccccggtgaggcacttcgcttagtactggggcccgatgtgcgagcattcgtgatgtgtcgcaggatccggttgtcaagccaagaggccagcagggctccggcgacagtgacgggtagcccgatcagcacgaggccccagccatgcggtgccgagaggtttctggccggcgtgcacgcgaggcaggcaaatgccatcactgccagcactacgacgtagatggtcgcataattcgacttgcgggtgacgttgccgaccatcttggccaaagtcgctggggaccagctgatgagtgcgatggtggtcagcaggaagcaggaccagacagacatccggcgcactcaggggtatgggtgcggctgtgggttttggaaaccgccatatgcggcgtagcgggggtgtgcccgcatgggtgcgctgggcagtgacagggcgagcagcccaggcgcccagagcctgacacagtgcagtcccagcccctggatctctatggtggtgaaatcttcgatgtacaggggtgacacacaggtgatgctgttgaccacgctctttaccagttccgcccccgtgtgggtgtcgtcaggtggcaggtcttcggcttgggcaatggtgcccgcgtcgaatttcgccacaactgattgcgcggcctgatagttcctcgcgtagtaggagacgttcgagtcgaggtcaagcatgtcctccgtggacatactggacgcgtcggcctcggcgtcgaaagacgtccataccgcgagcatccgaaccccgctgcactcgagaaacgccttgtacatggctgcttccagacccgcgtctgcacctaggccgacggcgacgaggggaagttggttgccactaccgaccatcatgcatgccacggtgaaatgcttgagcccgggagtcggaagccagtagaaacgcagttcgtggcttcggcccgctgcacgttccacgagccgctggatgcgctggaggcggggtccttcgacgcggatgcgcacaggtgacgaggctccataccacaggcccatcgcggcatctacctggatcaattcataagccgcggacagcgttgcggcgacgcgtgaagtgtggacggcggtgccggtcgtcacggccgttcccagccacggctcaccgtcgtgccgacgggggttgtaacccaggtaaaagaactgcgccgggatccactcctgccgggaggtcccgacacggggagtcttgacccatgtcatgggcaagtcgtcgcgataggtgtcgaacgcacctccagccactcgttgcgcgaagccgaatgcgcccagatcgagaacttcgtcctcggtccgggcgaggagttcctgacgagtcgcccagcgccgttcgaagggactatggagaatcccggtacccgcgcagtagcgctcgacggcctccgcgtagaccttgatctctgcctcaaactcgttcagccccaccccaccgatgtggtagctacccggcttggggtcgggccggtcaagcagtgcgtgcatccccgtgagttccccaccgttcacccgcacgcgggggccgagcgcggggtgcagcgagtagccgacggaagtcaccagcccgcatagcgggctgtaggtgcgccgcctgagccgggctgcggtctcgacggggtcgctatcctggcgaagcttcatcgctcgccccctgccgccagccactcacggatgtcgtagtacaggtccggagcggtttcaacctgcgctggtgcatcaaaacgggacataggtaggacgtcgttgtaggcgatctccatcgtcggtatgtagaccgacaacactttgttgcgcgtcgtgttgaggccgttgcgggcgatgctgacagcctcatgcgcgacgtgcgcggccaagatcgcgcgcaccgacgctgccacggccggcgctccggcccttacgcggtcggcagcggccacccgcatccaggacaggtagctctgccgttcgcgcaggttcatcgcgacccgctgctcgaaggtccggtaggacgaggtcgcaccagggacgacgtagggacccacgtacaaggccggcccgtctacagctgcgtggagccacgacaggtgggcgcgtcgggcgaacaggtcaagggcgcgcagcatagccgggttgttctgcgccagcgctaccacaaggagtggctgcaggtccggcgccgaacccagcaacgccaacatctgggaggcctcctgctccatgtgcaactcgtcggccgactgctcaagccgcaggcctgcgaagagggtggctgatggctgcgtgtcgtcagcgaggacggtagcctgcagcccctctccctcgagaatctgctggatatcgccggcgaggagcgcgtcgtcgctgaatacccacaccgggcgcgtctctctacctccatccatcttgtcctcaacgttttcgaccagcgcaccgatcgatgctaggtgggccatcacgtcgtcaagggccgcgcgggtcaatccgggcacccgggacacgatctcgggcggctgcagtccttggctcaacaagtccaaggccggccacagggtcccggtggcgtcgtcgtcctccagcgttgtgctctcggcgttccagacgcctcgacggaactccaccctgtccatcgagtaaggcaccatcatgaggcccggtgaaatgtggttggtcactttggctcctgtacagcctaggcttggacgcccacggtcatggtgtgggtcgcggtttggaaaatcccgtcgaggttgagtgcctgattgagttcgtcctcgtagaagcttgaggactcgactgaggcaagaccgagccccgtgcagaccaagttgatctgttgtgcgatcgccccgacttcttgaagggcgaacctcaaacccctggctccgtacttccgcatcgccctccacggcgagatgacgaacaccaagtgcactccggccgcatccgattgctccacggccggctcgccggccatcgaattcctcacgccgcgacagccctcttcaccggtcacgggcaccagtcgatcgatgaccggcgagtagcggtagacgccgcgactcaagccggacacccgttgtgcggacatgaagatagacacgggatacagccctccaccagacgggacagcgcgtacattataccgcacgatatcaccgctcgaacgtgggacatccacgtgccccgtcacaccggcagcacctctcagaaacgcagctacgtcacgcaggtctagggattcgccggtgtagttccgtccgctgcgccggcgggcgatcacttgctcgaggggtgcgcgcaccctgctggacctgggaagttcgatcacatcggcagcgaacgtgtcgcgatccatctgtccgtacgtaacgatcatggggtcaacgaaatagtcgccgaccgagacgttgaactccatatccccccgggcgatgcgcgaggcgagcaagaagtctgcagctgcgttagacagccccggcccatcagtgttgtcgcagcggaactcgtgggtccgaaaccccacaccttccgtgcccgggctctgcgctcgatacgacgtgatcgcagaactagccttccttaaaccgcccggagtagctaccatgaccgtcccctctgaggtctcccgaacacttgcgacaatagcagcatgtgggggcagccgccagaggcgggcatccttgtctcgacaaccattgacctccggattcgatatgtgcataatcatagtcgtgccaacacgaaacgtgtacgtctcggaagacgacctagacctgttcgccgaagccaccgagatcgctggaggcctgtccgcagcggtgttggaggccttgcgcagctacgtagacaggcaccatcgcgcggccggcggattcgacgagatcgagctggagctgcagaacgacggtatcgaccaccgtgtcaccttcatgggtcgccgcctgatacacatccgccgtccagatcccgagggaacccgcatagacactgtctacttgaccgccaaacaccaattcgccgttgccaccaaaatccaacgacggctgccagactggacggccggccacgagcacatctggtccgacccggagacctggaatcgggagttctggatcgcaggtgacaagacgatggccgtgtatcccagccttgacaaactccgcgaagctgaccccaatgtggccgaacgcgccgaggccgcggtcaaaatcccgccgttcgaggtcctggacatctgatgacagaatcatcatcttcccggcggcaattggcaatgccggtgctgtcagtcacggatctagccaagaaatacgtggttcatggcggctacgaggtcccggcactcaacggtgtctcgtttgacctgcacccgggagagatgctgggtttgttcgggccaaacggtgctggaaagacgacgctggtcaggatcatcgcgggcctcttatcggcagattctggagacgtccactggggatcggatcaaggtcgggccaggttaggctacgtgtcccaaaagggtggactgcagtacgggctcacgtgccgggaagagatggtcttccacgcacaatgcttcggccagtccgccaagcaggcccggactagcgtcgacgaggtcgccgcgatgctgcactgcgattacctgatggagtgggacgtcggaaggctctccggtgggcaacgccgaatcatcgaggtagggctagcactcgtcaatcaaccatcggtcgtcctgctcgacgagcccaccctgggcctggaccccgcaacacgcctgtcgttgtggcaaacggtaaagtcggcacgccgtgagaccggtgctgccttcctcgtcaccacccactacattgacgaggtggccgagcacctgtccaacgtcagcgtgatcaaccacggaaccgtcgtcgccaacggctcgccagcgcacatccgagaaatgttcgcgaccggggaagtaacgctcggcgtggccgaggatacggtggacagtgcggtggacgtgttggctgggaccgcgttcgaggcgcaccccaccgaaaccgtcccggggatcgtggtcaggtccaggcatcccgacgtggacgcggccaagatcatcaccatcctggctggtcatggcatctcggtggactccatatccgtacgcgaggcgaccttggaagaggcgtttctcacgatcacaggcagtcgagacccggagaggcaaatcccatgaacacttgcttcaggcgatatgcggcgatgtcgctgagagcgcggcgtgatttggccctgacattcatccagcccctcgtctacctagccctcttcggaccgctcttcgtcacgacgatgaagatgtcgcagagagctaccgccgctacgggttactccctatacatcacgggcctgtccatccaaatggccatgacgatcggtgccttcgcggggctaaccatcatcctcgaataccgactcggcatcctcgaacggatctggagcacccccctcacggggagcaagatgatggcggggcgaatcgcgcgcgacgtcgttatgatgatgatgccgatactggtcgtcttcatcatcggcctggtgctgggaacacgccccagcccactgggcctggcgacctacttcgtgacagtgctcggcacaggagccacgttcgccggggtctcctacgcggtggcactcagaacgaagagcgaggcagcgctatccgcgatcttcaacctcatcctgctacccatcctcctgctgtcggggatcatgctgcccatgtcgttcgcaccacactggatcgccaccgctgcccacgtgaacccgttgtggtacctggtgcaaggcgcgcggaaccagttcagcgttctagggctcgtggcggcggccccatggagttgggctgtggccatcgtcatgtcagccgctgccttcggctgggcaagccacgaattcaacaagaggcgctgacacaaagaatggtgccgggaacccaggtccccggcaccaccgagtgcactcgcgacgtcaacgcaccgttgcggtcactgcgcaggtcgagcacgaggacgacgagcccgcgctgctgcaggtcgagccgccaggcgcgagcaggtcgacgttagcgtcggcgccgccgaagacggacgtgacggccggctgagaggtgcggatgcggtgctccagcgaggaggtggtggtgagtttcatgggaggtgctcctaggagtgagacgagaacaaaccctagcgataggttagcagtccgcaaccgactccgggaatagtagaagcgcgcatccgtagcggaagaccttagcctgattacagtgaccctgttcgcgtctcaacattattccacacccccgagcagcgaacgacaccgcgatgatgatccgtcgcctctccaccgaagaactccgcgcccacatcgcaccgggccgccgtcccgtgcatcagacctgccgtcaacgtcggccatgaagctgggaaggtggctctcgtctaggagcagacgcgggacgcctcctccaggttgggccggggaagtgtccggttcttgatgtaggtggcggtccctattgatgggcgttgaccgtgggaatgcggtcggcgaagggggtggcgaacccgttgagcgcaggcttccagcgcatgcatcaacgctgtctgccggccaccggcaagcctcacccgcccgtcatggccatcatcgaggtgccggtgaatcctcgacacatgatcccaactcccccggaggggcttccggggctgttcagccaccagatcagccaggcggcgagcccgactctgccacccggaccctgcagagcgtgcctgctgccgtcgtgtcgtgtcgggccagtgggccaccagatcggccacatccgtcttggcccatctcc

SEQ ID NO: 110 - DNA, 16494 bp, Propionibacterium acnes
gtgttccagtgcctcgcgggcgtgatgttcttcttcggcaccttcttgccacatgcttcgcgcttcagcctcgccatccaagcgaacctggactgtgaacgagtcctcatcgggtccgtcctcattccacgcggcaatgatcccacgggcctcgtctgcgacctgactcaacttcatcgcctgcccgacagccccgagagccggaatctcgaacacccagatattcgcctcagccgagacctcacgatgggcgatcacttcgtaggtcgtctcaccttctactgtcgtgtccattacttccactccttcggaattttcacgcctgctcgctccagctgtgccaggacaccaactgacgtcagctggtgtcctgctggtatcgatacgcgcccggctccgccggggcgtccccagatttcatggcttcccttggcgttccgcagacgggcccatccttgagaacggagcagcttgaggacgtccttagttttctgcggtttcacacatcatagtatagccccacttaacttgtaaactaagcccctgtttacattttagttggtgcatgtgatccctgctcttatgacgtcgcccgacctggcgccttagacatgcactgttcatcctcaaccacactcaccgtcacgggtccgaaggcgaggtctatcaccattcgcatcgatgaagttgaagcaggatcgtccgcatcacgcactgccgatccggacagacgccaccggccgtaccgactgtttacgatctgccaccgcagactgctgccataaccgctatcacctctgatagtacgtttagtactatcagaggtgattcaagattctcctgtcgagcagccctacagtcacgaagtcctgcgatcgtcatcgcttaaggcagacggatggccatcggggaccactcgcaaagcaggggcgatcagcaacagtgatgtgccatgagcaagtactggtgcaccggctgtttactccgcccctagataaaccacgggtgcaggggtggacaccacaccatgaccgatgtggtgcccaccccatggctcacaggcaggccctatcgccgggagcactgctgcagatgaggctcagtaacctgccatgtctcacctggggccaaggtgccaagctccccacggaatctcaggcatcggaaaccagcagccgaacttccacagcatgagcgccctacgaaaaagcaggccgccgacggttctcaagaactcgccggcggcctgcatcgccactcgaactgtaaccgtggtccgaccccgtgcacaggtaagctccacactcccaccaggcatggccgaggcagtaccaagttgccgtggcccatcggcagatttggttaaattttgaaaagtcatatagactccttctgtaaatttttaaatctcataggactctcgccatcgccagccagcttcgacaggagtcccgatgtttcaccgagtgaaatatcggcaccgtttgagttgacctaaagctcaaaagatgctagaatccatcttacctcgttaggggcgttttgtcaaacgcccctatattgcgtgtcttcgcgcgtcgtagcgctgatgctgcgcctgtgtcgactatccgtttgtaagtactttcgatgacaccagcagtggctactcatgactggtgcgtgcgggtctaaagcagcagggaaaggaatcgcagtagaagccgcttgattcctatcacccctgatggtactatcagtactaacagagcagggcttactcgatgcgtgagaatcggggacatgctgagcctctcgtaggtcattggcctgctgggcgtcagtgtggcgcggttcgatccagtgaactctatcagctctgttagtactgtcagagttgatatattcgaccccaggaggagcccatgagttacatcgttcgcaccggaaatttggtcgacacccccgagctgcgtgagggagagcatggcccgtacacctacgctcgcgtcatcgtgtccgatcgcattcgccaggaggacggcagctacgtcaacgggccagcgatcgcctacgacgtcttggcgggtggcagccaagccgtgaatctggttgaagccgccaaggcgagcggcaacatccgcatcatgttcgcgggccgttaccgcgtcaccgagtggcggggtgagcagggcactcgtatccagcatgaggtccgagccgacgaagtgagcgtgagcctgctcggtcagagggtgaccgtggagcggcctcgaggtgacgtggcatccaaggagagcacgtcgttctgattgagtccgggggcacggtggtcgccgtggtaaaccgtgcccctgacagtactattgacactattggaggtatcagtgtgactgctcaaattttcgccttgtgcaaccagaagggtggcgtcggaaagtcgacatcgacgtttcatctggcccgtgccgcggtgttgcgtggccagcgtgtgcttgtcgtcgacaacgacccccagggcaacctgacgtctgtcgcggccgccgagcccgtgggggaggatcaggcggggctggccgatgtgctcagcgcgcgtgctccagagaccctccgcgatgtgatcgtgccgggaatctggtctggcctcgatgtcgtgccgacgtctggcatcacgctcggctgggtgcgtgacgaactcgtgatcgccggtgccggccgagaaggccggctgcgggaggccctggccggcgtcgaggacgactacgacgtgatcctgatcgactgtgctccatcgctcgatcagctcacgatcaacggcctggtggccgcccagggtgtcatcgtcgtgacgcactcgaagttgtggagcgccaacggcctcgcccagctgctcgacaccatcgacagcgtgcgcagctactacaacggcgcgctgcgcgtggcgggcatcatcgtcaaccagcacgaggagaacaccatcagcgggaaaacctggctcgacgagctgcatcaggctgccgagtcccggaagctgaccgtgcttgacccgccgatccccaagcgtgtcgtcatcgccgataccgtcgaggccgcgcgcggtctcgacgagtggggaagtgccgaggcggccgcgctcggccagttgtacgcccaccacctgacctgcatcgaaggagccctgtgatgacccgtccagccccccgaaagtcctcattgagcggatcaactccggtcgccccgccggctcagacggcgccggcaccgtctgccgcacctaccccccacaaggccgatgagtcacagacgagcagcaccacgaggaagtggcggcacaaggtgtcgttctaccaggacccggccgacaccgaccgggtgcgcggggcgatcctttacacgatgacgaccgagggcaaccggaacctgagccagttcgtcaacgatgccgtcatggccaaggtggtcgagctggaagtcaagtacaacgatggccagccattccccgctgtgggagcccgaggactaccccagggcggtgcagccgccgccggtgagtagaggaccatcgaccgtcgggggcttcaccatgcccccgaccctcggtcatcctgatcctcttgtcgatggtggtgacagtgggggattcacgcctcgttcagatcagaggaagtctcaccgcgtgattagtactatcaaatctgacagtactaacagagcagatagggttccctaggtcgagctgtatcacgccgacaaccagtgagccagtgatctacgaggggcgcaatatgcacccgatcggtagccgcgaaggcctcgccctgccccgatagtactatcaccactatcaatggtgctagtggtgagtttcttccattgatgacaacagcacagtgctgccgtctgtgtgcgggccaccagcccgcacacagttgccgtcgaggacgttgttcatgctctgtggtggccggtcctgagggcggctcgcaggatctcccggcgctcacggcgacgagcctggtagccaaggtctgcatgttcggcggcgagacgggctttgagggttgcggcttctgcacggcggtggagttggtcgtcgatgagttgggcgcgggccagacgccgcttatgggggttgtcgtgggtgaggggggcgtcgaggctgccgtcgtgggttagggccagggctgctcgttcggcgtcgtcgaggccgatgtggtggacggtcacgggtgcggtggtgacgtcgaggatgtccaggtggatgttgtggccgccgccgggggcttcggggaagtctggtgggctggcctggccggtgtcggggtcataccaggacaggccgatgatctcggcccagggtgggggcgggcagacggctcgcagaagggtgtgggccaggaacgtgttgcgggccatgatgcctccaagggtgaaaagcagtcgagtagcgatgacggcggggtagccgtctgctgggctgaggccgaccgggcccatgtcctcgatgctcttgtgctgcggccataccccaaagctaccaaacagtctttttaatctcaaagatacaaacagtgcttgacatattatctgcagcgaaagatactttcatcatggtggctgatcatgattacgcgactcctgacgatgagtggatgacacctcctcaggtggcccgtgtgattccgaacaccactgctcaggctgtccggcgctgggctgaggagggtcagcttcctggggcgtttcgtactccttctgggcgttggcatattccgtggtcggctgtggtgggcatcatggggtttgatccgcgtgagtccgcatcaccgagtgatcgtcaccagagctgacagagtcgtcgatgagctttcgagtgcagagctgatggcacgacggtctggatacttgtggagatgagagacgaccacatccagtcatggtcggggtacaccgaggggcagattcagcagtgctggcacgatgaggttgcccctgccattgactcgctcatggagcaggtaaggtctgttgccgagactcctgtgccgccgggttcgagattttacggcgatgagcagtgggccaagccttttcatccgtctactgcgatctgcggttcaatgggtccgccagcgatcacttgcacgcgctgaagctcctcgtctgggaagcgaacgtccaccatgtctatgcgccgtacacccttgctcgtgcatctattgaggcatcgtctactgctgtgtggctgttgagcacgaagacgcgcggagaacgtgtgctgcgagccttgcgatggtacgcgcaggattgtcacgactcgtgcaggttcatggatgatgagcagtatcgtgaccacctattgcggcgcattgaggggactgtcgctgcgggaaatctcgactcgcgcgctgctaggaaacggtaccgtgcaaccgatgttgtcgatgaggctgatcagctggttcccggaactctgagggcgtggcgagctttttctggtatggcccattcccgtatgtgggcatccagggggctgctcgacatggaagtgctgtccagtggccaaggaatggttacggcgaaggtgacgagcggatcggcccaaatcctttgggccgtcgtggcagctctgaatgttgctctcagtgccgctcgcttgtggcgtgattcgatgtgctcaccgtttgctgttgcccagtcggtagacgcgatgccagaggcgtttcgccgccctgtttagggtctgatcggggtagtgggtgttcacggggtcccaggttggccatggggcggcttggtgatgtgagttgggttgtgtggcagcctgggtgttgggtgtggcttcgttggccacgaaggcatgctcttccttgtgctgggacttgagtccccagtgctctcccctttgctagtggggggtggggtccccggaggtaggtcctccggggactttttctatgtctgtccgtgccccaggatttcgtatctaggcagtaccaattttgggttagttggaggtttctttggtaatggacagggtgagggtgatgaagaggtggccgtccttggtggcagaaattttctcgaacttcagctgaatgttgttatcagccactatctgttgggcggtgaggtgctcggagagcttctggaatccttcgcggatccacaggttgtaggggttggtgaccgagaccgaagggtatgggtcgaccttcagcgtcaggactggctggtctgggttgagggagttgatcttcaccagtttggggtaccggtcgcactcatgtgtctcttgtgttgggggccagcagtcgggggcccattcctcccagtggtcacgcatctcacgaagtactttcctgcatctcagcctctgcaggagctcgcgcgccaccgatgggagggctgccatgatgagggcaaggactgcgaacccgatgatgtaattgaccgtgtccctcgtcacgccgttcttgccgaggattccgatggcgaacgcgatgacgacaccgcccaggcacaggtgcatggggtcatgctgtgatggtttttcttcttcagcgactggtggggctatagtcatgtgtgccccttagtactaagtgatactggtgggttgcttttccccggtggccgtgtgcaagacggccaccggggttttccttcatgttcctgattttatctgcccggtgtggcgttttcatctttgtgtgggtggttcgcctggggtcttggagtgtggtgacgcggtgatggtcacggtgacggtgactgtggcgcgtggcgggtgaggtggttctttcctggtctggtgtgtggcccaggtgagtgtggtgatgagggccagggtgaggatgatgaccagggtggggagtagtttgtctggccggtgtcgccgggcttggtggcgcggcatgtttttccagggtgtgtctccgaacaggtcgtcgtcggaggggtcgtcgtggttcatagggtggccttggcgatggtggtgggcgagtttggtccaggtgatggtgccgtcggaggcgatgtggcggtcggcgggcagggtgtggacggtccatccggcgtcggtgagggcggtggtgaaggatttcttgatggatcgtttgggtaggtcgatgggggcgtgggtgccgacccagatgcaccggtttttgaggtgggtggcgccgaggtggttcatgtcgcggaccatgttttgggtgagtgtgagggtgtcggggtcccattggacggggatgatgatgtggtctgcgatggtgatggcgtgttgccaggcggcgtcgaggtcgttgtttccggtgtcgaggatgatgacgtggaagcggcttcttagggcggtgatgatgcggtcgaggtcgtcggcggtggggggtgtgatgaggctgttgtggttgtcggtgatggtgggtaggcatgtgatggtggcccagccttctggttgccaggagatgtaggggccgaggtcgcggggttgggaggcgaatcctgggtgacgggctgcgcgggcgaggtcgatgacggtgttgtcggtgtggcggggtgcgcgggtggagagggtgccgcgtgggttgatttccacgacgacgatgtcgtcgtgtcctgctgtggtggcgagggcttgggcaaggatgacggccagcggggttttgccggtgccgcctttgaggttggcgagggtgatgatgtggtcggtgagttgggcgggtgcggcggtgtggtgagggttggcggtgaggttggcgatggtgaacagggcatcgagatcgtcggtggtgttctgctcggtgggttgggggtcgccggagatgatcgggtcggcgcggcgcggctgccatgccggcctcaccactgtcacgaccaccacgggtctgctggcgctgtgtgggtgtcgtcggcgatgactcacgatcggcagtctcaccatcgtctcggtgatgctcggctagcgctggacccggtcaagttcgggccggctcacccagtggtgatgactcggtcacagaaccgctgccggtcgttatctcggacgtctcgactcctccagtcctgatgggcgttggagccacctacacctactctcagaacgaccccgacctcgtgtggggcgggggcagatgtcacttgggccaatcgagagcccaggtgatggggaaagcaggggtgtgatatctgtcctggaaaactgggcagctgctaccgtggattgacggatctccacgaaagaagggaatgcgaccatgcagatcaccgtcaagaccatcaaagatcatcgggttcgcactgtccagaccgccatgagcagcgccttggggattggttcccaggtagacatgctcgcccccggcggttccaccagctcgagttccggttcatgctgctcgtgctcgacctgcgcggtagtggcgcagcctcaagactgaacggctggtcagccccaggggcgtggcgctcatcgcgtcacgccccttctattcgctggacagggtgcgcgagctgaggaacatcgcggtgtgtgcgatgacgaggggcaggagcaagtctgtgcgggttgccaagtagccctgcgcgatggccatcacgctggccccgacggcggcgaagacacctccgatacgtcgcttcatgccgccgaattgcatcaggacgaataggactcccgcggtccacatccctccgggcatgcatctgggaaagatgaaccggaagatgatctcttcacaggagagctggagtactagcagcgtagcccccacggggagactcacctctactgacagacggatcgtcttcatccacccacccgagctggcatcgaccatttcggtggccatgcgcgaccggtggcctcgtgcctctcgctgcgtgtcgatccagccgagcagtccgtggacgctctccgctaggactcctgacgcgacagtctcaccaattcctaagcccacggcgaggaccgcgacgcccccctgcacggcaggctgtgtgacttggtggtcccaccaacccgccggcaggaccatgcgtgcgaggctgcacacgagcaggaggtggagggtcacgacgagcgacatctggaataccgcttgccgttcggcgatggtggcgttgggaaagagcggtaggccggcacgggcagcggcgctcgacagcttccgcaagagcggtttggagacgaagtagtaggcgacgtacagcgccagcgctgtcgcgatgatgatcatcggtctgccaccgagctgacccgccgatagccgtttctgttccaccaatactggctgttgtagatcaggtggcccagaacacaggcccagatcccccagaagatgaacaggatagtccccaaggcggcgagcgggatcttggagaggacctgtccccgtccgaacaccgagtggccgcaagcaaacaagagtgctcccacagcggtgagcgcgagccaggccggggttgctcgcagactgatcaccgggaccccgacccggaagccgacctcttctcctacagcgatgactagcaactgccacagcggcatgttctgaacggagcgcgcgactcgggctcgagtcacccacacgggctgttgagcgctcacatcaccactcaggtaccccggtgaggcacttcgcttagtactggggcccgatgtgcgagcattcgtgatgtgtcgcaggatccggttgtcaagccaagaggccagcagggctccggcgacagtgacgggtagcccgatcagcacgaggccccagccatgcggtgccgagaggtttctggccggcgtgcacgcgaggcaggcaaatgccatcactgccagcactacgacgtagatggtcgcataattcgacttgcgggtgacgttgccgaccatcttggccaaagtcgctggggaccagctgatgagtgcgatggtggtcagcaggaagcaggaccagacagacatccggcgcactcaggggtatgggtgcggctgtgggttttggaaaccgccatatgcggcgtagcgggggtgtgcccgcatgggtgcgctgggcagtgacagggcgagcagcccaggcgcccagagcctgacacagtgcagtcccagcccctggatctctatggtggtgaaatcttcgatgtacaggggtgacacacaggtgatgctgttgaccacgctctttaccagttccgcccccgtgtgggtgtcgtcaggtggcaggtcttcggcttgggcaatggtgcccgcgtcgaatttcgccacaactgattgcgcggcctgatagttcctcgcgtagtaggagacgttcgagtcgaggtcaagcatgtcctccgtggacatactggacgcgtcggcctcggcgtcgaaagacgtccataccgcgagcatccgaaccccgctgcactcgagaaacgccttgtacatggctgcttccagacccgcgtctgcacctaggccgacggcgacgaggggaagttggttgccactaccgaccatcatgcatgccacggtgaaatgcttgagcccgggagtcggaagccagtagaaacgcagttcgtggcttcggcccgctgcacgttccacgagccgctggatgcgctggaggcggggtccttcgacgcggatgcgcacaggtgacgaggctccataccacaggcccatcgcggcatctacctggatcaattcataagccgcggacagcgttgcggcgacgcgtgaagtgtggacggcggtgccggtcgtcacggccgttcccagccacggctcaccgtcgtgccgacgggggttgtaacccaggtaaaagaactgcgccgggatccactcctgccgggaggtcccgacacggggagtcttgacccatgtcatgggcaagtcgtcgcgataggtgtcgaacgcacctccagccactcgttgcgcgaagccgaatgcgcccagatcgagaacttcgtcctcggtccgggcgaggagttcctgacgagtcgcccagcgccgttcgaagggactatggagaatcccggtacccgcgcagtagcgctcgacggcctccgcgtagaccttgatctctgcctcaaactcgttcagccccaccccaccgatgtggtagctacccggcttggggtcgggccggtcaagcagtgcgtgcatccccgtgagttccccaccgttcacccgcacgcgggggccgagcgcggggtgcagcgagtagccgacggaagtcaccagcccgcatagcgggctgtaggtgcgccgcctgagccgggctgcggtctcgacggggtcgctatcctggcgaagcttcatcgctcgccccctgccgccagccactcacggatgtcgtagtacaggtccggagcggtttcaacctgcgctggtgcatcaaaacgggacataggtaggacgtcgttgtaggcgatctccatcgtcggtatgtagaccgacaacactttgttgcgcgtcgtgttgaggccgttgcgggcgatgctgacagcctcatgcgcgacgtgcgcggccaagatcgcgcgcaccgacgctgccacggccggcgctccggcccttacgcggtcggcagcggccacccgcatccaggacaggtagctctgccgttcgcgcaggttcatcgcgacccgctgctcgaaggtccggtaggacgaggtcgcaccagggacgacgtagggacccacgtacaaggccggcccgtctacagctgcgtggagccacgacaggtgggcgcgtcgggcgaacaggtcaagggcgcgcagcatagccgggttgttctgcgccagcgctaccacaaggagtggctgcaggtccggcgccgaacccagcaacgccaacatctgggaggcctcctgctccatgtgcaactcgtcggccgactgctcaagccgcaggcctgcgaagagggtggctgatggctgcgtgtcgtcagcgaggacggtagcctgcagcccctctccctcgagaatctgctggatatcgccggcgaggagcgcgtcgtcgctgaatacccacaccgggcgcgtctctctacctccatccatcttgtcctcaacgttttcgaccagcgcaccgatcgatgctaggtgggccatcacgtcgtcaagggccgcgcgggtcaatccgggcacccgggacacgatctcgggcggctgcagtccttggctcaacaagtccaaggccggccacagggtcccggtggcgtcgtcgtcctccagcgttgtgctctcggcgttccagacgcctcgacggaactccaccctgtccatcgagtaaggcaccatcatgaggcccggtgaaatgtggttggtcactttggctcctgtacagcctaggcttggacgcccacggtcatggtgtgggtcgcggtttggaaaatcccgtcgaggttgagtgcctgattgagttcgtcctcgtagaagcttgaggactcgactgaggcaagaccgagccccgtgcagaccaagttgatctgttgtgcgatcgccccgacttcttgaagggcgaacctcaaacccctggctccgtacttccgcatcgccctccacggcgagatgacgaacaccaagtgcactccggccgcatccgattgctccacggccggctcgccggccatcgaattcctcacgccgcgacagccctcttcaccggtcacgggcaccagtcgatcgatgaccggcgagtagcggtagacgccgcgactcaagccggacacccgttgtgcggacatgaagatagacacgggatacagccctccaccagacgggacagcgcgtacattataccgcacgatatcaccgctcgaacgtgggacatccacgtgccccgtcacaccggcagcacctctcagaaacgcagctacgtcacgcaggtctagggattcgccggtgtagttccgtccgctgcgccggcgggcgatcacttgctcgaggggtgcgcgcaccctgctggacctgggaagttcgatcacatcggcagcgaacgtgtcgcgatccatctgtccgtacgtaacgatcatggggtcaacgaaatagtcgccgaccgagacgttgaactccatatccccccgggcgatgcgcgaggcgagcaagaagtctgcagctgcgttagacagccccggcccatcagtgttgtcgcagcggaactcgtgggtccgaaaccccacaccttccgtgcccgggctctgcgctcgatacgacgtgatcgcagaactagccttccttaaaccgcccggagtagctaccatgaccgtcccctctgaggtctcccgaacacttgcgacaatagcagcatgtgggggcagccgccagaggcgggcatccttgtctcgacaaccattgacctccggattcgatatgtgcataatcatagtcgtgccaacacgaaacgtgtacgtctcggaagacgacctagacctgttcgccgaagccaccgagatcgctggaggcctgtccgcagcggtgttggaggccttgcgcagctacgtagacaggcaccatcgcgcggccggcggattcgacgagatcgagctggagctgcagaacgacggtatcgaccaccgtgtcaccttcatgggtcgccgcctgatacacatccgccgtccagatcccgagggaacccgcatagacactgtctacttgaccgccaaacaccaattcgccgttgccaccaaaatccaacgacggctgccagactggacggccggccacgagcacatctggtccgacccggagacctggaatcgggagttctggatcgcaggtgacaagacgatggccgtgtatcccagccttgacaaactccgcgaagctgaccccaatgtggccgaacgcgccgaggccgcggtcaaaatcccgccgttcgaggtcctggacatctgatgacagaatcatcatcttcccggcggcaattggcaatgccggtgctgtcagtcacggatctagccaagaaatacgtggttcatggcggctacgaggtcccggcactcaacggtgtctcgtttgacctgcacccgggagagatgctgggtttgttcgggccaaacggtgctggaaagacgacgctggtcaggatcatcgcgggcctcttatcggcagattctggagacgtccactggggatcggatcaaggtcgggccaggttaggctacgtgtcccaaaagggtggactgcagtacgggctcacgtgccgggaagagatggtcttccacgcacaatgcttcggccagtccgccaagcaggcccggactagcgtcgacgaggtcgccgcgatgctgcactgcgattacctgatggagtgggacgtcggaaggctctccggtgggcaacgccgaatcatcgaggtagggctagcactcgtcaatcaaccatcggtcgtcctgctcgacgagcccaccctgggcctggaccccgcaacacgcctgtcgttgtggcaaacggtaaagtcggcacgccgtgagaccggtgctgccttcctcgtcaccacccactacattgacgaggtggccgagcacctgtccaacgtcagcgtgatcaaccacggaaccgtcgtcgccaacggctcgcccgcgcacatccgagaaatgttcgcgaccggggaagtaacgctcggcgtggccgaggatacggtggacagtgcggtggacgtgttggctgggaccgcgttcgaggcgcaccccaccgaaaccgtcccggggatcgtggtcaggtccaggcatcccgacgtggacgcggccaagatcatcaccatcctggctggtcatggcatctcggtggactccatatccgtacgcgaggcgaccttggaagaggcgtttctcacgatcacaggcagtcgagacccggagaggcaaatcccatgaacacttgcttcaggcgatatgcggcgatgtcgctgagagcgcggcgtgatttggccctgacattcatccagcccctcgtctacctagccctcttcggaccgctcttcgtcacgacgatgaagatgtcgcagagagctaccgccgctacgggttactccctatacatcacgggcctgtccatccaaatggccatgacgatcggtgccttcgcggggctaaccatcatcctcgaataccgactcggcatcctcgaacggatctggagcacccccctcacggggagcaagatgatggcggggcgaatcgcgcgcgacgtcgttatgatgatgatgccgatactggtcgtcttcatcatcggcctggtgctgggaacacgccccagcccactgggcctggcgacctacttcgtgacagtgctcggcacaggagccacgttcgccggggtctcctacgcggtggcactcagaacgaagagcgaggcagcgctatccgcgatcttcaacctcatcctgctacccatcctcctgctgtcggggatcatgctgcccatgtcgttcgcaccacactggatcgccaccgctgcccacgtgaacccgttgtggtacctggtgcaaggcgcgcggaaccagttcagcgttctagggctcgtggcggcggccccatggagttgggctgtggccatcgtcatgtcagccgctgccttcggctgggcaagccacgaattcaacaagaggcgctgacacaaagaatggtgccgggaacccaggtccccggcaccaccgagtgcactcgcgacgtcaacgcaccgttgcggtcactgcgcaggtcgagcacgaggacgacgagcccgcgctgctgcaggtcgagccgccaggcgcgagcaggtcgacgttagcgtcggcgccgccgaagacggacgtgacggccggctgagaggtgcggatgcggtgctccagcgaggaggtggtggtgagtttcatgggaggtgctcctaggagtgagacgagaacaaaccctagcgataggttagcagtccgcaaccgactccgggaatagtagaagcgcgcatccgtagcggaagaccttagcctgattacagtgaccctgttcgcgtctcaacattattccacacccccgagcagcgaacgacaccgcgatgatgatccgtcgcctctccaccgaagaactccgcgcccacatcgcaccgggccgccgtcccgtgcatcagacctgccgtcaacgtcggccatgaagctgggaaggtggctctcgtctaggagcagacgcgggacgcctcctccaggttgggccggggaagtgtccggttcttgatgtaggtggcggtccctattgatgggcgttgaccgtgggaatgcggtcggcgaagggggtggcgaacccgttgagcgcaggcttccagcgcatgcatcaacgctgtctgccggccaccggcaagcctcacccgcccgtcatggccatcatcgaggtgccggtgaatcctcgacacatgatcccaactcccccggaggggcttccggggctgttcagccaccagatcagccaggcggcgagcccgactctgccacccggaccctgcagagcgtgcctgctgccgtcgtgtcgtgtcgggccagtgggccaccagatcggccacatccgtcttggcccatct

SEQ ID NO: 111 - DNA, 16494 bp, Propionibacterium acnes
gtgttccagtgcctcgcgggcgtgatgttcttcttcggcaccttcttgccacatgcttcgcgcttcagcctcgccatccaagcgaacctggactgtgaacgagtcctcatcgggtccgtcctcattccacgcggcaatgatcccacgggcctcgtctgcgacctgactcaacttcatcgcctgcccgacagccccgagagccggaatctcgaacacccagatattcgcctcagccgagacctcacgatgggcgatcacttcgtaggtcgtctcaccttctactgtcgtgtccattacttccactccttcggaattttcacgcctgctcgctccagctgtgccaggacaccaactgacgtcagctggtgtcctgctggtatcgatacgcgcccggctccgccggggcgtccccagatttcatggcttcccttggcgttccgcagacgggcccatccttgagaacggagcagcttgaggacgtccttagttttctgcggtttcacacatcatagtatagccccacttaacttgtaaactaagcccctgtttacattttagttggtgcatgtgatccctgctcttatgacgtcgcccgacctggcgccttagacatgcactgttcatcctcaaccacactcaccgtcacgggtccgaaggcgaggtctatcaccattcgcatcgatgaagttgaagcaggatcgtccgcatcacgcactgccgatccggacagacgccaccggccgtaccgactgtttacgatctgccaccgcagactgctgccataaccgctatcacctctgatagtacgtttagtactatcagaggtgattcaagattctcctgtcgagcagccctacagtcacgaagtcctgcgatcgtcatcgcttaaggcagacggatggccatcggggaccactcgcaaagcaggggcgatcagcaacagtgatgtgccatgagcaagtactggtgcaccggctgtttactccgcccctagataaaccacgggtgcaggggtggacaccacaccatgaccgatgtggtgcccaccccatggctcacaggcaggccctatcgccgggagcactgctgcagatgaggctcagtaacctgccatgtctcacctggggccaaggtgccaagctccccacggaatctcaggcatcggaaaccagcagccgaacttccacagcatgagcgccctacgaaaaagcaggccgccgacggttctcaagaactcgccggcggcctgcatcgccactcgaactgtaaccgtggtccgaccccgtgcacaggtaagctccacactcccaccaggcatggccgaggcagtaccaagttgccgtggcccatcggcagatttggttaaattttgaaaagtcatatagactccttctgtaaatttttaaatctcataggactctcgccatcgccagccagcttcgacaggagtcccgatgtttcaccgagtgaaatatcggcaccgtttgagttgacctaaagctcaaaagatgctagaatccatcttacctcgttaggggcgttttgtcaaacgcccctatattgcgtgtcttcgcgcgtcgtagcgctgatgctgcgcctgtgtcgactatccgtttgtaagtactttcgatgacaccagcagtggctactcatgactggtgcgtgcgggtctaaagcagcagggaaaggaatcgcagtagaagccgcttgattcctatcacccctgatggtactatcagtactaacagagcagggcttactcgatgcgtgagaatcggggacatgctgagcctctcgtaggtcattggcctgctgggcgtcagtgtggcgcggttcgatccagtgaactctatcagctctgttagtactgtcagagttgatatattcgaccccaggaggagcccatgagttacatcgttcgcaccggaaatttggtcgacacccccgagctgcgtgagggagagcatggcccgtacacctacgctcgcgtcatcgtgtccgatcgcattcgccaggaggacggcagctacgtcaacgggccagcgatcgcctacgacgtcttggcgggtggcagccaagccgtgaatctggttgaagccgccaaggcgagcggcaacatccgcatcatgttcgcgggccgttaccgcgtcaccgagtggcggggtgagcagggcactcgtatccagcatgaggtccgagccgacgaagtgagcgtgagcctgctcggtcagagggtgaccgtggagcggcctcgaggtgacgtggcatccaaggagagcacgtcgttctgattgagtccgggggcacggtggtcgccgtggtaaaccgtgcccctgacagtactattgacactattggaggtatcagtgtgactgctcaaattttcgccttgtgcaaccagaagggtggcgtcggaaagtcgacatcgacgtttcatctggcccgtgccgcggtgttgcgtggccagcgtgtgcttgtcgtcgacaacgacccccagggcaacctgacgtctgtcgcggccgccgagcccgtgggggaggatcaggcggggctggccgatgtgctcagcgcgcgtgctccagagaccctccgcgatgtgatcgtgccgggaatctggtctggcctcgatgtcgtgccgacgtctggcatcacgctcggctgggtgcgtgacgaactcgtgatcgccggtgccggccgagaaggccggctgcgggaggccctggccggcgtcgaggacgactacgacgtgatcctgatcgactgtgctccatcgctcgatcagctcacgatcaacggcctggtggccgcccagggtgtcatcgtcgtgacgcactcgaagttgtggagcgccaacggcctcgcccagctgctcgacaccatcgacagcgtgcgcagctactacaacggcgcgctgcgcgtggcgggcatcatcgtcaaccagcacgaggagaacaccatcagcgggaaaacctggctcgacgagctgcatcaggctgccgagtcccggaagctgaccgtgcttgacccgccgatccccaagcgtgtcgtcatcgccgataccgtcgaggccgcgcgcggtctcgacgagtggggaagtgccgaggcggccgcgctcggccagttgtacgcccaccacctgacctgcatcgaaggagccctgtgatgacccgtccagccccccgaaagtcctcattgagcggatcaactccggtcgccccgccggctcagacggcgccggcaccgtctgccgcacctaccccccacaaggccgatgagtcacagacgagcagcaccacgaggaagtggcggcacaaggtgtcgttctaccaggacccggccgacaccgaccgggtgcgcggggcgatcctttacacgatgacgaccgagggcaaccggaacctgagccagttcgtcaacgatgccgtcatggccaaggtggtcgagctggaagtcaagtacaacgatggccagccattccccgctgtgggagcccgaggactaccccagggcggtgcagccgccgccggtgagtagaggaccatcgaccgtcgggggcttcaccatgcccccgaccctcggtcatcctgatcctcttgtcgatggtggtgacagtgggggattcacgcctcgttcagatcagaggaagtctcaccgcgtgattagtactatcaaatctgacagtactaacagagcagatagggttccctaggtcgagctgtatcacgccgacaaccagtgagccagtgatctacgaggggcgcaatatgcacccgatcggtagccgcgaaggcctcgccctgccccgatagtactatcaccactatcaatggtgctagtggtgagtttcttccattgatgacaacagcacagtgctgccgtctgtgtgcgggccaccagcccgcacacagttgccgtcgaggacgttgttcatgctctgtggtggccggtcctgagggcggctcgcaggatctcccggcgctcacggcgacgagcctggtagccaaggtctgcatgttcggcggcgagacgggctttgagggttgcggcttctgcacggcggtggagttggtcgtcgatgagttgggcgcgggccagacgccgcttatgggggttgtcgtgggtgaggggggcgtcgaggctgccgtcgtgggttagggccagggctgctcgttcggcgtcgtcgaggccgatgtggtggacggtcacgggtgcggtggtgacgtcgaggatgtccaggtggatgttgtggccgccgccgggggcttcggggaagtctggtgggctggcctggccggtgtcggggtcataccaggacaggccgatgatctcggcccagggtgggggcgggcagacggctcgcagaagggtgtgggccaggaacgtgttgcgggccatgatgcctccaagggtgaaaagcagtcgagtagcgatgacggcggggtagccgtctgctgggctgaggccgaccgggcccatgtcctcgatgctcttgtgctgcggccataccccaaagctaccaaacagtctttttaatctcaaagatacaaacagtgcttgacatattatctgcagcgaaagatactttcatcatggtggctgatcatgattacgcgactcctgacgatgagtggatgacacctcctcaggtggcccgtgtgattccgaacaccactgctcaggctgtccggcgctgggctgaggagggtcagcttcctggggcgtttcgtactccttctgggcgttggcatattccgtggtcggctgtggtgggcatcatggggtttgatccgcgtgagtccgcatcaccgagtgatcgtcaccagagctgacagagtcgtcgatgagctttcgagtgcagagctgatggcacgacggtctggatacttgtggagatgagagacgaccacatccagtcatggtcggggtacaccgaggggcagattcagcagtgctggcacgatgaggttgcccctgccattgactcgctcatggagcaggtaaggtctgttgccgagactcctgtgccgccgggttcgagattttacggcgatgagcagtgggccaagccttttcatccgtctactgcgatctgcggttcaatgggtccgccagcgatcacttgcacgcgctgaagctcctcgtctgggaagcgaacgtccaccatgtctatgcgccgtacacccttgctcgtgcatctattgaggcatcgtctactgctgtgtggctgttgagcacgaagacgcgcggagaacgtgtgctgcgagccttgcgatggtacgcgcaggattgtcacgactcgtgcaggttcatggatgatgagcagtatcgtgaccacctattgcggcgcattgaggggactgtcgctgcgggaaatctcgactcgcgcgctgctaggaaacggtaccgtgcaaccgatgttgtcgatgaggctgatcagctggttcccggaactctgagggcgtggcgagctttttctggtatggcccattcccgtatgtgggcatccagggggctgctcgacatggaagtgctgtccagtggccaaggaatggttacggcgaaggtgacgagcggatcggcccaaatcctttgggccgtcgtggcagctctgaatgttgctctcagtgccgctcgcttgtggcgtgattcgatgtgctcaccgtttgctgttgcccagtcggtagacgcgatgccagaggcgtttcgccgccctgtttagggtctgatcggggtagtgggtgttcacggggtcccaggttggccatggggcggcttggtgatgtgagttgggttgtgtggcagcctgggtgttgggtgtggcttcgttggccacgaaggcatgctcttccttgtgctgggacttgagtccccagtgctctcccctttgctagtggggggtggggtccccggaggtaggtcctccggggactttttctatgtctgtccgtgccccaggatttcgtatctaggcagtaccaattttgggttagttggaggtttctttggtaatggacagggtgagggtgatgaagaggtggccgtccttggtggcagaaattttctcgaacttcagctgaatgttgttatcagccactatctgttgggcggtgaggtgctcggagagcttctggaatccttcgcggatccacaggttgtaggggttggtgaccgagaccgaagggtatgggtcgaccttcagcgtcaggactggctggtctgggttgagggagttgatcttcaccagtttggggtaccggtcgcactcatgtgtctcttgtgttgggggccagcagtcgggggcccattcctcccagtggtcacgcatctcacgaagtactttcctgcatctcagcctctgcaggagctcgcgcgccaccgatgggagggctgccatgatgagggcaaggactgcgaacccgatgatgtaattgaccgtgtccctcgtcacgccgttcttgccgaggattccgatggcgaacgcgatgacgacaccgcccaggcacaggtgcatggggtcatgctgtgatggtttttcttcttcagcgactggtggggctatagtcatgtgtgccccttagtactaagtgatactggtgggttgcttttccccggtggccgtgtgcaagacggccaccggggttttccttcatgttcctgattttatctgcccggtgtggcgttttcatctttgtgtgggtggttcgcctggggtcttggagtgtggtgacgcggtgatggtcacggtgacggtgactgtggcgcgtggcgggtgaggtggttctttcctggtctggtgtgtggcccaggtgagtgtggtgatgagggccagggtgaggatgatgaccagggtggggagtagtttgtctggccggtgtcgccgggcttggtggcgcggcatgtttttccagggtgtgtctccgaacaggtcgtcgtcggaggggtcgtcgtggttcatagggtggccttggcgatggtggtgggcgagtttggtccaggtgatggtgccgtcggaggcgatgtggcggtcggcgggcagggtgtggacggtccatccggcgtcggtgagggcggtggtgaaggatttcttgatggatcgtttgggtaggtcgatgggggcgtgggtgccgacccagatgcaccggtttttgaggtgggtggcgccgaggtggttcatgtcgcggaccatgttttgggtgagtgtgagggtgtcggggtcccattggacggggatgatgatgtggtctgcgatggtgatggcgtgttgccaggcggcgtcgaggtcgttgtttccggtgtcgaggatgatgacgtggaagcggcttcttagggcggtgatgatgcggtcgaggtcgtcggcggtggggggtgtgatgaggctgttgtggttgtcggtgatggtgggtaggcatgtgatggtggcccagccttctggttgccaggagatgtaggggccgaggtcgcggggttgggaggcgaatcctgggtgacgggctgcgcgggcgaggtcgatgacggtgttgtcggtgtggcggggggcgcgggtggagagggtgccgcgtgggttgatttccacgacgacgatgtcgtcgtgtcctgctgtggtggcgagggcttgggcaaggatgacggccagcggggttttgccggtgccgcctttgaggttggcgagggtgatgatgtggtcggtgagttgggcgggtgcggcggtgtggtgagggttggcggtgaggttggcgatggtgaacagggcatcgagatcgtcggtggtgttctgctcggtgggttgggggtcgccggagatgatcgggtcggcgcggcgcggctgccatgccggcctcaccactgtcacgaccaccacgggtctgctggcgctgtgtgggtgtcgtcggcgatgactcacgatcggcagtctcaccatcgtctcggtgatgctcggctagcgctggacccggtcaagttcgggccggctcacccagtggtgatgactcggtcacagaaccgctgccggtcgttatctcggacgtctcgactcctccagtcctgatgggcgttggagccacctacacctactctcagaacgaccccgacctcgtgtggggcgggggcagatgtcacttgggccaatcgagagcccaggtgatggggaaagcaggggtgtgatatctgtcctggaaaactgggcagctgctaccgtggattgacggatctccacgaaagaagggaatgcgaccatgcagatcaccgtcaagaccatcaaagatcatcgggttcgcactgtccagaccgccatgagcagcgccttggggattggttcccaggtagacatgctcgcccccggcggttccaccagctcgagttccggttcatgctgctcgtgctcgacctgcgcggtagtggcgcagcctcaagactgaacggctggtcagccccaggggcgtggcgctcatcgcgtcacgccccttctattcgctggacagggtgcgcgagctgaggaacatcgcggtgtgtgcgatgacgaggggcaggagcaagtctgtgcgggttgccaagtagccctgcgcgatggccatcacgctggccccgacggcggcgaagacacctccgatacgtcgcttcatgccgccgaattgcatcaggacgaataggactcccgcggtccacatccctccgggcatgcatctgggaaagatgaaccggaagatgatctcttcacaggagagctggagtactagcagcgtagcccccacggggagactcacctctactgacagacggatcgtcttcatccacccacccgagctggcatcgaccatttcggtggccatgcgcgaccggtggcctcgtgcctctcgctgcgtgtcgatccagccgagcagtccgtggacgctctccgctaggactcctgacgcgacagtctcaccaattcctaagcccacggcgaggaccgcgacgcccccctgcacggcaggctgtgtgacttggtggtcccaccaacccgccggcaggaccatgcgtgcgaggctgcacacgagcaggaggtggagggtcacgacgagcgacatctggaataccgcttgccgttcggcgatggtggcgttgggaaagagcggtaggccggcacgggcagcggcgctcgacagcttccgcaagagcggtttggagacgaagtagtaggcgacgtacagcgccagcgctgtcgcgatgatgatcatcggtctgccaccgagctgacccgccgatagccgtttctgttccaccaatactggctgttgtagatcaggtggcccagaacacaggcccagatcccccagaagatgaacaggatagtccccaaggcggcgagcgggatcttggagaggacctgtccccgtccgaacaccgagtggccgcaagcaaacaagagtgctcccacagcggtgagcgcgagccaggccggggttgctcgcagactgatcaccgggaccccgacccggaagccgacctcttctcctacagcgatgactagcaactgccacagcggcatgttctgaacggagcgcgcgactcgggctcgagtcacccacacgggctgttgagcgctcacatcaccactcaggtaccccggtgaggcacttcgcttagtactggggcccgatgtgcgagcattcgtgatgtgtcgcaggatccggttgtcaagccaagaggccagcagggctccggcgacagtgacgggtagcccgatcagcacgaggccccagccatgcggtgccgagaggtttctggccggcgtgcacgcgaggcaggcaaatgccatcactgccagcactacgacgtagatggtcgcataattcgacttgcgggtgacgttgccgaccatcttggccaaagtcgctggggaccagctgatgagtgcgatggtggtcagcaggaagcaggaccagacagacatccggcgcactcaggggtatgggtgcggctgtgggttttggaaaccgccatatgcggcgtagcgggggtgtgcccgcatgggtgcgctgggcagtgacagggcgagcagcccaggcgcccagagcctgacacagtgcagtcccagcccctggatctctatggtggtgaaatcttcgatgtacaggggtgacacacaggtgatgctgttgaccacgctctttaccagttccgcccccgtgtgggtgtcgtcaggtggcaggtcttcggcttgggcaatggtgcccgcgtcgaatttcgccacaactgattgcgcggcctgatagttcctcgcgtagtaggagacgttcgagtcgaggtcaagcatgtcctccgtggacatactggacgcgtcggcctcggcgtcgaaagacgtccataccgcgagcatccgaaccccgctgcactcgagaaacgccttgtacatggctgcttccagacccgcgtctgcacctaggccgacggcgacgaggggaagttggttgccactaccgaccatcatgcatgccacggtgaaatgcttgagcccgggagtcggaagccagtagaaacgcagttcgtggcttcggcccgctgcacgttccacgagccgctggatgcgctggaggcggggtccttcgacgcggatgcgcacaggtgacgaggctccataccacaggcccatcgcggcatctacctggatcaattcataagccgcggacagcgttgcggcgacgcgtgaagtgtggacggcggtgccggtcgtcacggccgttcccagccacggctcaccgtcgtgccgacgggggttgtaacccaggtaaaagaactgcgccgggatccactcctgccgggaggtcccgacacggggagtcttgacccatgtcatgggcaagtcgtcgcgataggtgtcgaacgcacctccagccactcgttgcgcgaagccgaatgcgcccagatcgagaacttcgtcctcggtccgggcgaggagttcctgacgagtcgcccagcgccgttcgaagggactatggagaatcccggtacccgcgcagtagcgctcgacggcctccgcgtagaccttgatctctgcctcaaactcgttcagccccaccccaccgatgtggtagctacccggcttggggtcgggccggtcaagcagtgcgtgcatccccgtgagttccccaccgttcacccgcacgcgggggccgagcgcggggtgcagcgagtagccgacggaagtcaccagcccgcatagcgggctgtaggtgcgccgcctgagccgggctgcggtctcgacggggtcgctatcctggcgaagcttcatcgctcgccccctgccgccagccactcacggatgtcgtagtacaggtccggagcggtttcaacctgcgctggtgcatcaaaacgggacataggtaggacgtcgttgtaggcgatctccatcgtcggtatgtagaccgacaacactttgttgcgcgtcgtgttgaggccgttgcgggcgatgctgacagcctcatgcgcgacgtgcgcggccaagatcgcgcgcaccgacgctgccacggccggcgctccggcccttacgcggtcggcagcggccacccgcatccaggacaggtagctctgccgttcgcgcaggttcatcgcgacccgctgctcgaaggtccggtaggacgaggtcgcaccagggacgacgtagggacccacgtacaaggccggcccgtctacagctgcgtggagccacgacaggtgggcgcgtcgggcgaacaggtcaagggcgcgcagcatagccgggttgttctgcgccagcgctaccacaaggagtggctgcaggtccggcgccgaacccagcaacgccaacatctgggaggcctcctgctccatgtgcaactcgtcggccgactgctcaagccgcaggcctgcgaagagggtggctgatggctgcgtgtcgtcagcgaggacggtagcctgcagcccctctccctcgagaatctgctggatatcgccggcgaggagcgcgtcgtcgctgaatacccacaccgggcgcgtctctctacctccatccatcttgtcctcaacgttttcgaccagcgcaccgatcgatgctaggtgggccatcacgtcgtcaagggccgcgcgggtcaatccgggcacccgggacacgatctcgggcggctgcagtccttggctcaacaagtccaaggccggccacagggtcccggtggcgtcgtcgtcctccagcgttgtgctctcggcgttccagacgcctcgacggaactccaccctgtccatcgagtaaggcaccatcatgaggcccggtgaaatgtggttggtcactttggctcctgtacagcctaggcttggacgcccacggtcatggtgtgggtcgcggtttggaaaatcccgtcgaggttgagtgcctgattgagttcgtcctcgtagaagcttgaggactcgactgaggcaagaccgagccccgtgcagaccaagttgatctgttgtgcgatcgccccgacttcttgaagggcgaacctcaaacccctggctccgtacttccgcatcgccctccacggcgagatgacgaacaccaagtgcactccggccgcatccgattgctccacggccggctcgccggccatcgaattcctcacgccgcgacagccctcttcaccggtcacgggcaccagtcgatcgatgaccggcgagtagcggtagacgccgcgactcaagccggacacccgttgtgcggacatgaagatagacacgggatacagccctccaccagacgggacagcgcgtacattataccgcacgatatcaccgctcgaacgtgggacatccacgtgccccgtcacaccggcagcacctctcagaaacgcagctacgtcacgcaggtctagggattcgccggtgtagttccgtccgctgcgccggcgggcgatcacttgctcgaggggtgcgcgcaccctgctggacctgggaagttcgatcacatcggcagcgaacgtgtcgcgatccatctgtccgtacgtaacgatcatggggtcaacgaaatagtcgccgaccgagacgttgaactccatatccccccgggcgatgcgcgaggcgagcaagaagtctgcagctgcgttagacagccccggcccatcagtgttgtcgcagcggaactcgtgggtccgaaaccccacaccttccgtgcccgggctctgcgctcgatacgacgtgatcgcagaactagccttccttaaaccgcccggagtagctaccatgaccgtcccctctgaggtctcccgaacacttgcgacaatagcagcatgtgggggcagccgccagaggcgggcatccttgtctcgacaaccattgacctccggattcgatatgtgcataatcatagtcgtgccaacacgaaacgtgtacgtctcggaagacgacctagacctgttcgccgaagccaccgagatcgctggaggcctgtccgcagcggtgttggaggccttgcgcagctacgtagacaggcaccatcgcgcggccggcggattcgacgagatcgagctggagctgcagaacgacggtatcgaccaccgtgtcaccttcatgggtcgccgcctgatacacatccgccgtccagatcccgagggaacccgcatagacactgtctacttgaccgccaaacaccaattcgccgttgccaccaaaatccaacgacggctgccagactggacggccggccacgagcacatctggtccgacccggagacctggaatcgggagttctggatcgcaggtgacaagacgatggccgtgtatcccagccttgacaaactccgcgaagctgaccccaatgtggccgaacgcgccgaggccgcggtcaaaatcccgccgttcgaggtcctggacatctgatgacagaatcatcatcttcccggcggcaattggcaatgccggtgctgtcagtcacggatctagccaagaaatacgtggttcatggcggctacgaggtcccggcactcaacggtgtctcgtttgacctgcacccgggagagatgctgggtttgttcgggccaaacggtgctggaaagacgacgctggtcaggatcatcgcgggcctcttatcggcagattctggagacgtccactggggatcggatcaaggtcgggccaggttaggctacgtgtcccaaaagggtggactgcagtacgggctcacgtgccgggaagagatggtcttccacgcacaatgcttcggccagtccgccaagcaggcccggactagcgtcgacgaggtcgccgcgatgctgcactgcgattacctgatggagtgggacgtcggaaggctctccggtgggcaacgccgaatcatcgaggtagggctagcactcgtcaatcaaccatcggtcgtcctgctcgacgagcccaccctgggcctggaccccgcaacacgcctgtcgttgtggcaaacggtaaagtcggcacgccgtgagaccggtgctgccttcctcgtcaccacccactacattgacgaggtggccgagcacctgtccaacgtcagcgtgatcaaccacggaaccgtcgtcgccaacggctcgccagcgcacatccgagaaatgttcgcgaccggggaagtaacgctcggcgtggccgaggatacggtggacagtgcggtggacgtgttggctgggaccgcgttcgaggcgcaccccaccgaaaccgtcccggggatcgtggtcaggtccaggcatcccgacgtggacgcggccaagatcatcaccatcctggctggtcatggcatctcggtggactccatatccgtacgcgaggcgaccttggaagaggcgtttctcacgatcacaggcagtcgagacccggagaggcaaatcccatgaacacttgcttcaggcgatatgcggcgatgtcgctgagagcgcggcgtgatttggccctgacattcatccagcccctcgtctacctagccctcttcggaccgctcttcgtcacgacgatgaagatgtcgcagagagctaccgccgctacgggttactccctatacatcacgggcctgtccatccaaatggccatgacgatcggtgccttcgcggggctaaccatcatcctcgaataccgactcggcatcctcgaacggatctggagcacccccctcacggggagcaagatgatggcggggcgaatcgcgcgcgacgtcgttatgatgatgatgccgatactggtcgtcttcatcatcggcctggtgctgggaacacgccccagcccactgggcctggcgacctacttcgtgacagtgctcggcacaggagccacgttcgccggggtctcctacgcggtggcactcagaacgaagagcgaggcagcgctatccgcgatcttcaacctcatcctgctacccatcctcctgctgtcggggatcatgctgcccatgtcgttcgcaccacactggatcgccaccgctgcccacgtgaacccgttgtggtacctggtgcaaggcgcgcggaaccagttcagcgttctagggctcgtggcggcggccccatggagttgggctgtggccatcgtcatgtcagccgctgccttcggctgggcaagccacgaattcaacaagaggcgctgacacaaagaatggtgccgggaacccaggtccccggcaccaccgagtgcactcgcgacgtcaacgcaccgttgcggtcactgcgcaggtcgagcacgaggacgacgagcccgcgctgctgcaggtcgagccgccaggcgcgagcaggtcgacgttagcgtcggcgccgccgaagacggacgtgacggccggctgagaggtgcggatgcggtgctccagcgaggaggtggtggtgagtttcatgggaggtgctcctaggagtgagacgagaacaaaccctagcgataggttagcagtccgcaaccgactccgggaatagtagaagcgcgcatccgtagcggaagaccttagcctgattacagtgaccctgttcgcgtctcaacattattccacacccccgagcagcgaacgacaccgcgatgatgatccgtcgcctctccaccgaagaactccgcgcccacatcgcaccgggccgccgtcccgtgcatcagacctgccgtcaacgtcggccatgaagctgggaaggtggctctcgtctaggagcagacgcgggacgcctcctccaggttgggccggggaagtgtccggttcttgatgtaggtggcggtccctattgatgggcgttgaccgtgggaatgcggtcggcgaagggggtggcgaacccgttgagcgcaggcttccagcgcatgcatcaacgctgtctgccggccaccggcaagcctcacccgcccgtcatggccatcatcgaggtgccggtgaatcctcgacacatgatcccaactcccccggaggggcttccggggctgttcagccaccagatcagccaggcggcgagcccgactctgccacccggaccctgcagagcgtgcctgctgccgtcgtgtcgtgtcgggccagtgggccaccagatcggccacatccgtcttggcccatct

SEQ ID NO: 112 - DNA, 16494 bp, Propionibacterium acnes
gtgttccagtgcctcgcgggcgtgatgttcttcttcggcaccttcttgccacatgcttcgcgcttcagcctcgccatccaagcgaacctggactgtgaacgagtcctcatcgggtccgtcctcattccacgcggcaatgatcccacgggcctcgtctgcgacctgactcaacttcatcgcctgcccgacagccccgagagccggaatctcgaacacccagatattcgcctcagccgagacctcacgatgggcgatcacttcgtaggtcgtctcaccttctactgtcgtgtccattacttccactccttcggaattttcacgcctgctcgctccagctgtgccaggacaccaactgacgtcagctggtgtcctgctggtatcgatacgcgcccggctccgccggggcgtccccagatttcatggcttcccttggcgttccgcagacgggcccatccttgagaacggagcagcttgaggacgtccttagttttctgcggtttcacacatcatagtatagccccacttaacttgtaaactaagcccctgtttacattttagttggtgcatgtgatccctgctcttatgacgtcgcccgacctggcgccttagacatgcactgttcatcctcaaccacactcaccgtcacgggtccgaaggcgaggtctatcaccattcgcatcgatgaagttgaagcaggatcgtccgcatcacgcactgccgatccggacagacgccaccggccgtaccgactgtttacgatctgccaccgcagactgctgccataaccgctatcacctctgatagtacgtttagtactatcagaggtgattcaagattctcctgtcgagcagccctacagtcacgaagtcctgcgatcgtcatcgcttaaggcagacggatggccatcggggaccactcgcaaagcaggggcgatcagcaacagtgatgtgccatgagcaagtactggtgcaccggctgtttactccgcccctagataaaccacgggtgcaggggtggacaccacaccatgaccgatgtggtgcccaccccatggctcacaggcaggccctatcgccgggagcactgctgcagatgaggctcagtaacctgccatgtctcacctggggccaaggtgccaagctccccacggaatctcaggcatcggaaaccagcagccgaacttccacagcatgagcgccctacgaaaaagcaggccgccgacggttctcaagaactcgccggcggcctgcatcgccactcgaactgtaaccgtggtccgaccccgtgcacaggtaagctccacactcccaccaggcatggccgaggcagtaccaagttgccgtggcccatcggcagatttggttaaattttgaaaagtcatatagactccttctgtaaatttttaaatctcataggactctcgccatcgccagccagcttcgacaggagtcccgatgtttcaccgagtgaaatatcggcaccgtttgagttgacctaaagctcaaaagatgctagaatccatcttacctcgttaggggcgttttgtcaaacgcccctatattgcgtgtcttcgcgcgtcgtagcgctgatgctgcgcctgtgtcgactatccgtttgtaagtactttcgatgacaccagcagtggctactcatgactggtgcgtgcgggtctaaagcagcagggaaaggaatcgcagtagaagccgcttgattcctatcacccctgatggtactatcagtactaacagagcagggcttactcgatgcgtgagaatcggggacatgctgagcctctcgtaggtcattggcctgctgggcgtcagtgtggcgcggttcgatccagtgaactctatcagctctgttagtactgtcagagttgatatattcgaccccaggaggagcccatgagttacatcgttcgcaccggaaatttggtcgacacccccgagctgcgtgagggagagcatggcccgtacacctacgctcgcgtcatcgtgtccgatcgcattcgccaggaggacggcagctacgtcaacgggccagcgatcgcctacgacgtcttggcgggtggcagccaagccgtgaatctggttgaagccgccaaggcgagcggcaacatccgcatcatgttcgcgggccgttaccgcgtcaccgagtggcggggtgagcagggcactcgtatccagcatgaggtccgagccgacgaagtgagcgtgagcctgctcggtcagagggtgaccgtggagcggcctcgaggtgacgtggcatccaaggagagcacgtcgttctgattgagtccgggggcacggtggtcgccgtggtaaaccgtgcccctgacagtactattgacactattggaggtatcagtgtgactgctcaaattttcgccttgtgcaaccagaagggtggcgtcggaaagtcgacatcgacgtttcatctggcccgtgccgcggtgttgcgtggccagcgtgtgcttgtcgtcgacaacgacccccagggcaacctgacgtctgtcgcggccgccgagcccgtgggggaggatcaggcggggctggccgatgtgctcagcgcgcgtgctccagagaccctccgcgatgtgatcgtgccgggaatctggtctggcctcgatgtcgtgccgacgtctggcatcacgctcggctgggtgcgtgacgaactcgtgatcgccggtgccggccgagaaggccggctgcgggaggccctggccggcgtcgaggacgactacgacgtgatcctgatcgactgtgctccatcgctcgatcagctcacgatcaacggcctggtggccgcccagggtgtcatcgtcgtgacgcactcgaagttgtggagcgccaacggcctcgcccagctgctcgacaccatcgacagcgtgcgcagctactacaacggcgcgctgcgcgtggcgggcatcatcgtcaaccagcacgaggagaacaccatcagcgggaaaacctggctcgacgagctgcatcaggctgccgagtcccggaagctgaccgtgcttgacccgccgatccccaagcgtgtcgtcatcgccgataccgtcgaggccgcgcgcggtctcgacgagtggggaagtgccgaggcggccgcgctcggccagttgtacgcccaccacctgacctgcatcgaaggagccctgtgatgacccgtccagccccccgaaagtcctcattgagcggatcaactccggtcgccccgccggctcagacggcgccggcaccgtctgccgcacctaccccccacaaggccgatgagtcacagacgagcagcaccacgaggaagtggcggcacaaggtgtcgttctaccaggacccggccgacaccgaccgggtgcgcggggcgatcctttacacgatgacgaccgagggcaaccggaacctgagccagttcgtcaacgatgccgtcatggccaaggtggtcgagctggaagtcaagtacaacgatggccagccattccccgctgtgggagcccgaggactaccccagggcggtgcagccgccgccggtgagtagaggaccatcgaccgtcgggggcttcaccatgcccccgaccctcggtcatcctgatcctcttgtcgatggtggtgacagtgggggattcacgcctcgttcagatcagaggaagtctcaccgcgtgattagtactatcaaatctgacagtactaacagagcagatagggttccctaggtcgagctgtatcacgccgacaaccagtgagccagtgatctacgaggggcgcaatatgcacccgatcggtagccgcgaaggcctcgccctgccccgatagtactatcaccactatcaatggtgctagtggtgagtttcttccattgatgacaacagcacagtgctgccgtctgtgtgcgggccaccagcccgcacacagttgccgtcgaggacgttgttcatgctctgtggtggccggtcctgagggcggctcgcaggatctcccggcgctcacggcgacgagcctggtagccaaggtctgcatgttcggcggcgagacgggctttgagggttgcggcttctgcacggcggtggagttggtcgtcgatgagttgggcgcgggccagacgccgcttatgggggttgtcgtgggtgaggggggcgtcgaggctgccgtcgtgggttagggccagggctgctcgttcggcgtcgtcgaggccgatgtggtggacggtcacgggtgcggtggtgacgtcgaggatgtccaggtggatgttgtggccgccgccgggggcttcggggaagtctggtgggctggcctggccggtgtcggggtcataccaggacaggccgatgatctcggcccagggtgggggcgggcagacggctcgcagaagggtgtgggccaggaacgtgttgcgggccatgatgcctccaagggtgaaaagcagtcgagtagcgatgacggcggggtagccgtctgctgggctgaggccgaccgggcccatgtcctcgatgctcttgtgctgcggccataccccaaagctaccaaacagtctttttaatctcaaagatacaaacagtgcttgacatattatctgcagcgaaagatactttcatcatggtggctgatcatgattacgcgactcctgacgatgagtggatgacacctcctcaggtggcccgtgtgattccgaacaccactgctcaggctgtccggcgctgggctgaggagggtcagcttcctggggcgtttcgtactccttctgggcgttggcatattccgtggtcggctgtggtgggcatcatggggtttgatccgcgtgagtccgcatcaccgagtgatcgtcaccagagctgacagagtcgtcgatgagctttcgagtgcagagctgatggcacgacggtctggatacttgtggagatgagagacgaccacatccagtcatggtcggggtacaccgaggggcagattcagcagtgctggcacgatgaggttgcccctgccattgactcgctcatggagcaggtaaggtctgttgccgagactcctgtgccgccgggttcgagattttacggcgatgagcagtgggccaagccttttcatccgtctactgcgatctgcggttcaatgggtccgccagcgatcacttgcacgcgctgaagctcctcgtctgggaagcgaacgtccaccatgtctatgcgccgtacacccttgctcgtgcatctattgaggcatcgtctactgctgtgtggctgttgagcacgaagacgcgcggagaacgtgtgctgcgagccttgcgatggtacgcgcaggattgtcacgactcgtgcaggttcatggatgatgagcagtatcgtgaccacctattgcggcgcattgaggggactgtcgctgcgggaaatctcgactcgcgcgctgctaggaaacggtaccgtgcaaccgatgttgtcgatgaggctgatcagctggttcccggaactctgagggcgtggcgagctttttctggtatggcccattcccgtatgtgggcatccagggggctgctcgacatggaagtgctgtccagtggccaaggaatggttacggcgaaggtgacgagcggatcggcccaaatcctttgggccgtcgtggcagctctgaatgttgctctcagtgccgctcgcttgtggcgtgattcgatgtgctcaccgtttgctgttgcccagtcggtagacgcgatgccagaggcgtttcgccgccctgtttagggtctgatcggggtagtgggtgttcacggggtcccaggttggccatggggcggcttggtgatgtgagttgggttgtgtggcagcctgggtgttgggtgtggcttcgttggccacgaaggcatgctcttccttgtgctgggacttgagtccccagtgctctcccctttgctagtggggggtggggtccccggaggtaggtcctccggggactttttctatgtctgtccgtgccccaggatttcgtatctaggcagtaccaattttgggttagttggaggtttctttggtaatggacagggtgagggtgatgaagaggtggccgtccttggtggcagaaattttctcgaacttcagctgaatgttgttatcagccactatctgttgggcggtgaggtgctcggagagcttctggaatccttcgcggatccacaggttgtaggggttggtgaccgagaccgaagggtatgggtcgaccttcagcgtcaggactggctggtctgggttgagggagttgatcttcaccagtttggggtaccggtcgcactcatgtgtctcttgtgttgggggccagcagtcgggggcccattcctcccagtggtcacgcatctcacgaagtactttcctgcatctcagcctctgcaggagctcgcgcgccaccgatgggagggctgccatgatgagggcaaggactgcgaacccgatgatgtaattgaccgtgtccctcgtcacgccgttcttgccgaggattccgatggcgaacgcgatgacgacaccgcccaggcacaggtgcatggggtcatgctgtgatggtttttcttcttcagcgactggtggggctatagtcatgtgtgccccttagtactaagtgatactggtgggttgcttttccccggtggccgtgtgcaagacggccaccggggttttccttcatgttcctgattttatctgcccggtgtggcgttttcatctttgtgtgggtggttcgcctggggtcttggagtgtggtgacgcggtgatggtcacggtgacggtgactgtggcgcgtggcgggtgaggtggttctttcctggtctggtgtgtggcccaggtgagtgtggtgatgagggccagggtgaggatgatgaccagggtggggagtagtttgtctggccggtgtcgccgggcttggtggcgcggcatgtttttccagggtgtgtctccgaacaggtcgtcgtcggaggggtcgtcgtggttcatagggtggccttggcgatggtggtgggcgagtttggtccaggtgatggtgccgtcggaggcgatgtggcggtcggcgggcagggtgtggacggtccatccggcgtcggtgagggcggtggtgaaggatttcttgatggatcgtttgggtaggtcgatgggggcgtgggtgccgacccagatgcaccggtttttgaggtgggtggcgccgaggtggttcatgtcgcggaccatgttttgggtgagtgtgagggtgtcggggtcccattggacggggatgatgatgtggtctgcgatggtgatggcgtgttgccaggcggcgtcgaggtcgttgtttccggtgtcgaggatgatgacgtggaagcggcttcttagggcggtgatgatgcggtcgaggtcgtcggcggtggggggtgtgatgaggctgttgtggttgtcggtgatggtgggtaggcatgtgatggtggcccagccttctggttgccaggagatgtaggggtcgaggtcgcggggttgggaggcgaatcctgggtgacgggctgcgcgggcgaggtcgatgacggtgttgtcggtgtggcggggtgcgcgggtggagagggtgccgcgtgggttgatttccacgacgacgatgtcgtcgtgtcctgctgtggtggcgagggcttgggcaaggatgacggccagcggggttttgccggtgccgcctttgaggttggcgagggtgatgatgtggtcggtgagttgggcgggtgcggcggtgtggtgagggttggcggtgaggttggcgatggtgaacagggcatcgagatcgtcggtggtgttctgctcggtgggttgggggtcgccggagatgatcgggtcggcgcggcgcggctgccatgccggcctcaccactgtcacgaccaccacgggtctgctggcgctgtgtgggtgtcgtcggcgatgactcacgatcggcagtctcaccatcgtctcggtgatgctcggctagcgctggacccggtcaagttcgggccggctcacccagtggtgatgactcggtcacagaaccgctgccggtcgttatctcggacgtctcgactcctccagtcctgatgggcgttggagccacctacacctactctcagaacgaccccgacctcgtgtggggcgggggcagatgtcacttgggccaatcgagagcccaggtgatggggaaagcaggggtgtgatatctgtcctggaaaactgggcagctgctaccgtggattgacggatctccacgaaagaagggaatgcgaccatgcagatcaccgtcaagaccatcaaagatcatcgggttcgcactgtccagaccgccatgagcagcgccttggggattggttcccaggtagacatgctcgcccccggcggttccaccagctcgagttccggttcatgctgctcgtgctcgacctgcgcggtagtggcgcagcctcaagactgaacggctggtcagccccaggggcgtggcgctcatcgcgtcacgccccttctattcgctggacagggtgcgcgagctgaggaacatcgcggtgtgtgcgatgacgaggggcaggagcaagtctgtgcgggttgccaagtagccctgcgcgatggccatcacgctggccccgacggcggcgaagacacctccgatacgtcgcttcatgccgccgaattgcatcaggacgaataggactcccgcggtccacatccctccgggcatgcatctgggaaagatgaaccggaagatgatctcttcacaggagagctggagtactagcagcgtagcccccacggggagactcacctctactgacagacggatcgtcttcatccacccacccgagctggcatcgaccatttcggtggccatgcgcgaccggtggcctcgtgcctctcgctgcgtgtcgatccagccgagcagtccgtggacgctctccgctaggactcctgacgcgacagtctcaccaattcctaagcccacggcgaggaccgcgacgcccccctgcacggcaggctgtgtgacttggtggtcccaccaacccgccggcaggaccatgcgtgcgaggctgcacacgagcaggaggtggagggtcacgacgagcgacatctggaataccgcttgccgttcggcgatggtggcgttgggaaagagcggtaggccggcacgggcagcggcgctcgacagcttccgcaagagcggtttggagacgaagtagtaggcgacgtacagcgccagcgctgtcgcgatgatgatcatcggtctgccaccgagctgacccgccgatagccgtttctgttccaccaatactggctgttgtagatcaggtggcccagaacacaggcccagatcccccagaagatgaacaggatagtccccaaggcggcgagcgggatcttggagaggacctgtccccgtccgaacaccgagtggccgcaagcaaacaagagtgctcccacagcggtgagcgcgagccaggccggggttgctcgcagactgatcaccgggaccccgacccggaagccgacctcttctcctacagcgatgactagcaactgccacagcggcatgttctgaacggagcgcgcgactcgggctcgagtcacccacacgggctgttgagcgctcacatcaccactcaggtaccccggtgaggcacttcgcttagtactggggcccgatgtgcgagcattcgtgatgtgtcgcaggatccggttgtcaagccaagaggccagcagggctccggcgacagtgacgggtagcccgatcagcacgaggccccagccatgcggtgccgagaggtttctggccggcgtgcacgcgaggcaggcaaatgccatcactgccagcactacgacgtagatggtcgcataattcgacttgcgggtgacgttgccgaccatcttggccaaagtcgctggggaccagctgatgagtgcgatggtggtcagcaggaagcaggaccagacagacatccggcgcactcaggggtatgggtgcggctgtgggttttggaaaccgccatatgcggcgtagcgggggtgtgcccgcatgggtgcgctgggcagtgacagggcgagcagcccaggcgcccagagcctgacacagtgcagtcccagcccctggatctctatggtggtgaaatcttcgatgtacaggggtgacacacaggtgatgctgttgaccacgctctttaccagttccgcccccgtgtgggtgtcgtcaggtggcaggtcttcggcttgggcaatggtgcccgcgtcgaatttcgccacaactgattgcgcggcctgatagttcctcgcgtagtaggagacgttcgagtcgaggtcaagcatgtcctccgtggacatactggacgcgtcggcctcggcgtcgaaagacgtccataccgcgagcatccgaaccccgctgcactcgagaaacgccttgtacatggctgcttccagacccgcgtctgcacctaggccgacggcgacgaggggaagttggttgccactaccgaccatcatgcatgccacggtgaaatgcttgagcccgggagtcggaagccagtagaaacgcagttcgtggcttcggcccgctgcacgttccacgagccgctggatgcgctggaggcggggtccttcgacgcggatgcgcacaggtgacgaggctccataccacaggcccatcgcggcatctacctggatcaattcataagccgcggacagcgttgcggcgacgcgtgaagtgtggacggcggtgccggtcgtcacggccgttcccagccacggctcaccgtcgtgccgacgggggttgtaacccaggtaaaagaactgcgccgggatccactcctgccgggaggtcccgacacggggagtcttgacccatgtcatgggcaagtcgtcgcgataggtgtcgaacgcacctccagccactcgttgcgcgaagccgaatgcgcccagatcgagaacttcgtcctcggtccgggcgaggagttcctgacgagtcgcccagcgccgttcgaagggactatggagaatcccggtacccgcgcagtagcgctcgacggcctccgcgtagaccttgatctctgcctcaaactcgttcagccccaccccaccgatgtggtagctacccggcttggggtcgggccggtcaagcagtgcgtgcatccccgtgagttccccaccgttcacccgcacgcgggggccgagcgcggggtgcagcgagtagccgacggaagtcaccagcccgcatagcgggctgtaggtgcgccgcctgagccgggctgcggtctcgacggggtcgctatcctggcgaagcttcatcgctcgccccctgccgccagccactcacggatgtcgtagtacaggtccggagcggtttcaacctgcgctggtgcatcaaaacgggacataggtaggacgtcgttgtaggcgatctccatcgtcggtatgtagaccgacaacactttgttgcgcgtcgtgttgaggccgttgcgggcgatgctgacagcctcatgcgcgacgtgcgcggccaagatcgcgcgcaccgacgctgccacggccggcgctccggcccttacgcggtcggcagcggccacccgcatccaggacaggtagctctgccgttcgcgcaggttcatcgcgacccgctgctcgaaggtccggtaggacgaggtcgcaccagggacgacgtagggacccacgtacaaggccggcccgtctacagctgcgtggagccacgacaggtgggcgcgtcgggcgaacaggtcaagggcgcgcagcatagccgggttgttctgcgccagcgctaccacaaggagtggctgcaggtccggcgccgaacccagcaacgccaacatctgggaggcctcctgctccatgtgcaactcgtcggccgactgctcaagccgcaggcctgcgaagagggtggctgatggctgcgtgtcgtcagcgaggacggtagcctgcagcccctctccctcgagaatctgctggatatcgccggcgaggagcgcgtcgtcgctgaatacccacaccgggcgcgtctctctacctccatccatcttgtcctcaacgttttcgaccagcgcaccgatcgatgctaggtgggccatcacgtcgtcaagggccgcgcgggtcaatccgggcacccgggacacgatctcgggcggctgcagtccttggctcaacaagtccaaggccggccacagggtcccggtggcgtcgtcgtcctccagcgttgtgctctcggcgttccagacgcctcgacggaactccaccctgtccatcgagtaaggcaccatcatgaggcccggtgaaatgtggttggtcactttggctcctgtacagcctaggcttggacgcccacggtcatggtgtgggtcgcggtttggaaaatcccgtcgaggttgagtgcctgattgagttcgtcctcgtagaagcttgaggactcgactgaggcaagaccgagccccgtgcagaccaagttgatctgttgtgcgatcgccccgacttcttgaagggcgaacctcaaacccctggctccgtacttccgcatcgccctccacggcgagatgacgaacaccaagtgcactccggccgcatccgattgctccacggccggctcgccggccatcgaattcctcacgccgcgacagccctcttcaccggtcacgggcaccagtcgatcgatgaccggcgagtagcggtagacgccgcgactcaagccggacacccgttgtgcggacatgaagatagacacgggatacagccctccaccagacgggacagcgcgtacattataccgcacgatatcaccgctcgaacgtgggacatccacgtgccccgtcacaccggcagcacctctcagaaacgcagctacgtcacgcaggtctagggattcgccggtgtagttccgtccgctgcgccggcgggcgatcacttgctcgaggggtgcgcgcaccctgctggacctgggaagttcgatcacatcggcagcgaacgtgtcgcgatccatctgtccgtacgtaacgatcatggggtcaacgaaatagtcgccgaccgagacgttgaactccatatccccccgggcgatgcgcgaggcgagcaagaagtctgcagctgcgttagacagccccggcccatcagtgttgtcgcagcggaactcgtgggtccgaaaccccacaccttccgtgcccgggctctgcgctcgatacgacgtgatcgcagaactagccttccttaaaccgcccggagtagctaccatgaccgtcccctctgaggtctcccgaacacttgcgacaatagcagcatgtgggggcagccgccagaggcgggcatccttgtctcgacaaccattgacctccggattcgatatgtgcataatcatagtcgtgccaacacgaaacgtgtacgtctcggaagacgacctagacctgttcgccgaagccaccgagatcgctggaggcctgtccgcagcggtgttggaggccttgcgcagctacgtagacaggcaccatcgcgcggccggcggattcgacgagatcgagctggagctgcagaacgacggtatcgaccaccgtgtcaccttcatgggtcgccgcctgatacacatccgccgtccagatcccgagggaacccgcatagacactgtctacttgaccgccaaacaccaattcgccgttgccaccaaaatccaacgacggctgccagactggacgaccggccacgagcacatctggtccgacccggagacctggaatcgggagttctggatcgcaggtgacaagacgatggccgtgtatcccagccttgacaaactccgcgaagctgaccccaatgtggccgaacgcgccgaggccgcggtcaaaatcccgccgttcgaggtcctggacatctgatgacagaatcatcatcttcccggcggcaattggcaatgccggtgctgtcagtcacggatctagccaagaaatacgtggttcatggcggctacgaggtcccggcactcaacggtgtctcgtttgacctgcacccgggagagatgctgggtttgttcgggccaaacggtgctggaaagacgacgctggtcaggatcatcgcgggcctcttatcggcagattctggagacgtccactggggatcggatcaaggtcgggccaggttaggctacgtgtcccaaaagggtggactgcagtacgggctcacgtgccgggaagagatggtcttccacgcacaatgcttcggccagtccgccaagcaggcccggactagcgtcgacgaggtcgccgcgatgctgcactgcgattacctgatggagtgggacgtcggaaggctctccggtgggcaacgccgaatcatcgaggtagggctagcactcgtcaatcaaccatcggtcgtcctgctcgacgagcccaccctgggcctggaccccgcaacacgcctgtcgttgtggcaaacggtaaagtcggcacgccgtgagaccggtgctgccttcctcgtcaccacccactacattgacgaggtggccgagcacctgtccaacgtcagcgtgatcaaccacggaaccgtcgtcgccaacggctcgccagcgcacatccgagaaatgttcgcgaccggggaagtaacgctcggcgtggccgaggatacggtggacagtgcggtggacgtgttggctgggaccgcgttcgaggcgcaccccaccgaaaccgtcccggggatcgtggtcaggtccaggcatcccgacgtggacgcggccaagatcatcaccatcctggctggtcatggcatctcggtggactccatatccgtacgcgaggcgaccttggaagaggcgtttctcacgatcacaggcagtcgagacccggagaggcaaatcccatgaacacttgcttcaggcgatatgcggcgatgtcgctgagagcgcggcgtgatttggccctgacattcatccagcccctcgtctacctagccctcttcggaccgctcttcgtcacgacgatgaagatgtcgcagagagctaccgccgctacgggttactccctatacatcacgggcctgtccatccaaatggccatgacgatcggtgccttcgcggggctaaccatcatcctcgaataccgactcggcatcctcgaacggatctggagcacccccctcacggggagcaagatgatggcggggcgaatcgcgcgcgacgtcgttatgatgatgatgccgatactggtcgtcttcatcatcggcctggtgctgggaacacgccccagcccactgggcctggcgacctacttcgtgacagtgctcggcacaggagccacgttcgccggggtctcctacgcggtggcactcagaacgaagagcgaggcagcgctatccgcgatcttcaacctcatcctgctacccatcctcctgctgtcggggatcatgctgcccatgtcgttcgcaccacactggatcgccaccgctgcccacgtgaacccgttgtggtacctggtgcaaggcgcgcggaaccagttcagcgttctagggctcgtggcggcggccccatggagttgggctgtggccatcgtcatgtcagccgctgccttcggctgggcaagccacgaattcaacaagaggcgctgacacaaagaatggtgccgggaacccaggtccccggcaccaccgagtgcactcgcgacgtcaacgcaccgttgcggtcactgcgcaggtcgagcacgaggacgacgagcccgcgctgctgcaggtcgagccgccaggcgcgagcaggtcgacgttagcgtcggcgccgccgaagacggacgtgacggccggctgagaggtgcggatgcggtgctccagcgaggaggtggtggtgagtttcatgggaggtgctcctaggagtgagacgagaacaaaccctagcgataggttagcagtccgcaaccgactccgggaatagtagaagcgcgcatccgtagcggaagaccttagcctgattacagtgaccctgttcgcgtctcaacattattccacacccccgagcagcgaacgacaccgcgatgatgatccgtcgcctctccaccgaagaactccgcgcccacatcgcaccgggccgccgtcccgtgcatcagacctgccgtcaacgtcggccatgaagctgggaaggtggctctcgtctaggagcagacgcgggacgcctcctccaggttgggccggggaagtgtccggttcttgatgtaggtggcggtccctattgatgggcgttgaccgtgggaatgcggtcggcgaagggggtggcgaacccgttgagcgcaggcttccagcgcatgcatcaacgctgtctgccggccaccggcaagcctcacccgcccgtcatggccatcatcgaggtgccggtgaatcctcgacacatgatcccaactcccccggaggggcttccggggctgttcagccaccagatcagccaggcggcgagcccgactctgccacccggaccctgcagagcgtgcctgctgccgtcgtgtcgtgtcgggccagtgggccaccagatcggccacatccgtcttggcccatct

SEQ ID NO: 113 - DNA, 16493 bp, Propionibacterium acnes
gtgttccagtgcctcgcgggcgtgatgttcttcttcggcaccttcttgccacatgcttcgcgcttcagcctcgccatccaagcgaacctggactgtgaacgagtcctcatcgggtccgtcctcattccacgcggcaatgatcccacgggcctcgtctgcgacctgactcaacttcatcgcctgcccgacagccccgagagccggaatctcgaacacccagatattcgcctcagccgagacctcacgatgggcgatcacttcgtaggtcgtctcaccttctactgtcgtgtccattacttccactccttcggaattttcacgcctgctcgctccagctgtgccaggacaccaactgacgtcagctggtgtcctgctggtatcgatacgcgcccggctccgccggggcgtccccagatttcatggcttcccttggcgttccgcagacgggcccatccttgagaacggagcagcttgaggacgtccttagttttctgcagtttcacacatcatagtatagccccacttaacttgtaaactaagcccctgtttacattttagttggtgcatgtgatccctgctcttatgacgtcgcccgacctggcgccttagacatgcactgttcatcctcaaccacactcaccgtcacgggtccgaaggcgaggtctatcaccattcgcatcgatgaagttgaagcaggatcgtccgcatcacgcactgccgatccggacagacgccaccggccgtaccgactgtttacgatctgccaccgcagactgctgccataaccgctatcacctctgatagtacgtttagtactatcagaggtgattcaagattctcctgtcgagcagccctacagtcacgaagtcctgcgatcgtcatcgcttaaggcagacggatggccatcggggaccactcgcaaagcaggggcgatcagcaacagtgatgtgccatgagcaagtactggtgcaccggctgtttactccgcccctagataaaccacgggtgcaggggtggacaccacaccatgaccgatgtggtgcccaccccatggctcacaggcaggccctatcgccgggagcactgctgcagatgaggctcagtaacctgccatgtctcacctggggccaaggtgccaagctccccacggaatctcaggcatcggaaaccagcagccgaacttccacagcatgagcgccctacgaaaaagcaggccgccgacggttctcaagaactcgccggcggcctgcatcgccactcgaactgtaaccgtggtccgaccccgtgcacaggtaagctccacactcccaccaggcatggccgaggcagtaccaagttgccgtggcccatcggcagatttggttaaattttgaaaagtcatatagactccttctgtaaatttttaaatctcataggactctcgccatcgccagccagcttcgacaggagtcccgatgtttcaccgagtgaaatatcggcaccgtttgagttgacctaaagctcaaaagatgctagaatccatcttacctcgttaggggcgttttgtcaaacgcccctatattgcgtgtcttcgcgcgtcgtagcgctgatgctgcgcctgtgtcgactatccgtttgtaagtactttcgatgacaccagcagtggctactcatgactggtgcgtgcgggtctaaagcagcagggaaaggaatcgcagtagaagccgcttgattcctatcacccctgatggtactatcagtactaacagagcagggcttactcgatgcgtgagaatcggggacatgctgagcctctcgtaggtcattggcctgctgggcgtcagtgtggcgcggttcgatccagtgaactctatcagctctgttagtactgtcagagttgatatattcgaccccaggaggagcccatgagttacatcgttcgcaccggaaatttggtcgacacccccgagctgcgtgagggagagcatggcccgtacacctacgctcgcgtcatcgtgtccgatcgcattcgccaggaggacggcagctacgtcaacgggccagcgatcgcctacgacgtcttggcgggtggcagccaagccgtgaatctggttgaagccgccaaggcgagcggcaacatccgcatcatgttcgcgggccgttaccgcgtcaccgagtggcgggggagcagggcactcgtatccagcatgaggtccgagccgacgaagtgagcgtgagcctgctcggtcagagggtgaccgtggagcggcctcgaggtgacgtggcatccaaggagagcacgtcgttctgattgagtccgggggcacggtggtcgccgtggtaaaccgtgcccctgacagtactattgacactattggaggtatcagtgtgactgctcaaattttcgccttgtgcaaccagaagggtggcgtcggaaagtcgacatcgacgtttcatctggcccgtgccgcggtgttgcgtggccagcgtgtgcttgtcgtcgacaacgacccccagggcaacctgacgtctgtcgcggccgccgagcccgtgggggaggatcaggcggggctggccgatgtgctcagcgcgcgtgctccagagaccctccgcgatgtgatcgtgccgggaatctggtctggcctcgatgtcgtgccgacgtctggcatcacgctcggctgggtgcgtgacgaactcgtgatcgccggtgccggccgagaaggccggctgcgggaggccctggccggcgtcgaggacgactacgacgtgatcctgatcgactgtgctccatcgctcgatcagctcacgatcaacggcctggtggccgcccagggtgtcatcgtcgtgacgcactcgaagttgtggagcgccaacggcctcgcccagctgctcgacaccatcgacagcgtgcgcagctactacaacggcgcgctgcgcgtggcgggcatcatcgtcaaccagcacgaggagaacaccatcagcgggaaaacctggctcgacgagctgcatcaggctgccgagtcccggaagctgaccgtgcttgacccgccgatccccaagcgtgtcgtcatcgccgataccgtcgaggccgcgcgcggtctcgacgagtggggaagtgccgaggcggccgcgctcggccagttgtacgcccaccacctgacctgcatcgaaggagccctgtgatgacccgtccagccccccgaaagtcctcattgagcggatcaactccggtcgccccgccggctcagacggcgccggcaccgtctgccgcacctaccccccacaaggccgatgagtcacagacgagcagcaccacgaggaagtggcggcacaaggtgtcgttctaccaggacccggccgacaccgaccgggtgcgcggggcgatcctttacacgatgacgaccgagggcaaccggaacctgagccagttcgtcaacgatgccgtcatggccaaggtggtcgagctggaagtcaagtacaacgatggccagccattccccgctgtgggagcccgaggactaccccagggcggtgcagccgccgccggtgagtagaggaccatcgaccgtcgggggcttcaccatgcccccgaccctcggtcatcctgatcctcttgtcgatggtggtgacagtgggggattcacgcctcgttcagatcagaggaagtctcaccgcgtgattagtactatcaaatctgacagtactaacagagcagatagggttccctaggtcgagctgtatcacgccgacaaccagtgagccagtgatctacgaggggcgcaatatgcacccgatcggtagccgcgaaggcctcgccctgccccgatagtactatcaccactatcaatggtgctagtggtgagtttcttccattgatgacaacagcacagtgctgccgtctgtgtgcgggccaccagcccgcacacagttgccgtcgaggacgttgttcatgctctgtggtggccggtcctgagggcggctcgcaggatctcccggcgctcacggcgacgagcctggtagccaaggtctgcatgttcggcggcgagacgggctttgagggttgcggcttctgcacggcggtggagttggtcgtcgatgagttgggcgcgggccagacgccgcttatgggggttgtcgtgggtgaggggggcgtcgaggctgccgtcgtgggttagggccagggctgctcgttcggcgtcgtcgaggccgatgtggtggacggtcacgggtgcggtggtgacgtcgaggatgtccaggtggatgttgtggccgccgccgggggcttcggggaagtctggtgggctggcctggccggtgtcggggtcataccaggacaggccgatgatctcggcccagggtgggggcgggcagacggctcgcagaagggtgtgggccaggaacgtgttgcgggccatgatgcctccaagggtgaaaagcagtcgagtagcgatgacggcggggtagccgtctgctgggctgaggccgaccgggcccatgtcctcgatgctcttgtgctgcggccataccccaaagctaccaaacagtctttttaatctcaaagatacaaacagtgcttgacatattatctgcagcgaaagatactttcatcatggtggctgatcatgattacgcgactcctgacgatgagtggatgacacctcctcaggtggcccgtgtgattccgaacaccactgctcaggctgtccggcgctgggctgaggagggtcagcttcctggggcgtttcgtactccttctgggcgttggcatattccgtggtcggctgtggtgggcatcatggggtttgatccgcgtgagtccgcatcaccgagtgatcgtcaccagagctgacagagtcgtcgatgagctttcgagtgcagagctgatggcacgacggtctggatacttgtggagatgagagacgaccacatccagtcatggtcggggtacaccgaggggcagattcagcagtgctggcacgatgaggttgcccctgccattgactcgctcatggagcaggtaaggtctgttgccgagactcctgtgccgccgggttcgagattttacggcgatgagcagtgggccaagccttttcatccgtctactgcgatctgcggttcaatgggtccgccagcgatcacttgcacgcgctgaagctcctcgtctgggaagcgaacgtccaccatgtctatgcgccgtacacccttgctcgtgcatctattgaggcatcgtctactgctgtgtggctgttgagcacgaagacgcgcggagaacgtgtgctgcgagccttgcgatggtacgcgcaggattgtcacgactcgtgcaggttcatggatgatgagcagtatcgtgaccacctattgcggcgcattgaggggactgtcgctgcgggaaatctcgactcgcgcgctgctaggaaacggtaccgtgcaaccgatgttgtcgatgaggctgatcagctggttcccggaactctgagggcgtggcgagctttttctggtatggcccattcccgtatgtgggcatccagggggctgctcgacatggaagtgctgtccagtggccaaggaatggttacggcgaaggtgacgagcggatcggcccaaatcctttgggccgtcgtggcagctctgaatgttgctctcagtgccgctcgcttgtggcgtgattcgatgtgctcaccgtttgctgttgcccagtcggtagacgcgatgccagaggcgtttcgccgccctgtttagggtctgatcggggtagtgggtgttcacggggtcccaggttggccatggggcggcttggtgatgtgagttgggttgtgtggcagcctgggtgttgggtgtggcttcgttggccacgaaggcatgctcttccttgtgctgggacttgagtccccagtgctctcccctttgctagtggggggtggggtccccggaggtaggtcctccggggactttttctatgtctgtccgtgccccaggatttcgtatctaggcagtaccaattttgggttagttggaggtttctttggtaatggacagggtgagggtgatgaagaggtggccgtccttggtggcagaaattttctcgaacttcagctgaatgttgttatcagccactatctgttgggcggtgaggtgctcggagagcttctggaatccttcgcggatccacaggttgtaggggttggtgaccgagaccgaagggtatgggtcgaccttcagcgtcaggactggctggtctgggttgagggagttgatcttcaccagtttggggtaccggtcgcactcatgtgtctcttgtgttgggggccagcagtcgggggcccattcctcccagtggtcacgcatctcacgaagtactttcctgcatctcagcctctgcaggagctcgcgcgccaccgatgggagggctgccatgatgagggcaaggactgcgaacccgatgatgtaattgaccgtgtccctcgtcacgccgttcttgccgaggattccgatggcgaacgcgatgacgacaccgcccaggcacaggtgcatggggtcatgctgtgatggtttttcttcttcagcgactggtggggctatagtcatgtgtgccccttagtactaagtgatactggtgggttgcttttccccggtggccgtgtgcaagacggccaccggggttttccttcatgttcctgattttatctgcccggtgtggcgttttcatctttgtgtgggtggttcgcctggggtcttggagtgtggtgacgcggtgatggtcacggtgacggtgactgtggcgcgtggcgggtgaggtggttctttcctggtctggtgtgtggcccaggtgagtgtggtgatgagggccagggtgaggatgatgaccagggtggggagtagtttgtctggccggtgtcgccgggcttggtggcgcggcatgtttttccagggtgtgtctccgaacaggtcgtcgtcggaggggtcgtcgtggttcatagggtggccttggcgatggtggtgggcgagtttggtccaggtgatggtgccgtcggaggcgatgtggcggtcggcgggcagggtgtggacggtccatccggcgtcggtgagggcggtggtgaaggatttcttgatggatcgtttgggtaggtcgatgggggcgtgggtgccgacccagatgcaccggtttttgaggtgggtggcgccgaggtggttcatgtcgcggaccatgttttgggtgagtgtgagggtgtcggggtcccattggacggggatgatgatgtggtctgcgatggtgatggcgtgttgccaggcggcgtcgaggtcgttgtttccggtgtcgaggatgatgacgtggaagcggcttcttagggcggtgatgatgcggtcgaggtcgtcggcggtggggggtgtgatgaggctgttgtggttgtcggtgatggtgggtaggcatgtgatggtggcccagccttctggttgccaggagatgtaggggccgaggtcgcggggttgggaggcgaatcctgggtgacgggctgcgcgggcgaggtcgatgacggtgttgtcggtgtggcggggtgcgcgggtggagagggtgccgcgtgggttgatttccacgacgacgatgtcgtcgtgtcctgctgtggtggcgagggcttgggcaaggatgacggccagcggggttttgccggtgccgcctttgaggttggcgagggtgatgatgtggtcggtgagttgggcgggtgcggcggtgtggtgagggttggcggtgaggttggcgatggtgaacagggcatcgagatcgtcggtggtgttctgctcggtgggttgggggtcgccggagatgatcgggtcggcgcggcgcggctgccatgccggcctcaccactgtcacgaccaccacgggtctgctggcgctgtgtgggtgtcgtcggcgatgactcacgatcggcagtctcaccatcgtctcggtgatgctcggctagcgctggacccggtcaagttcgggccggctcacccagtggtgatgactcggtcacagaaccgctgccggtcgttatctcggacgtctcgactcctccagtcctgatgggcgttggagccacctacacctactctcagaacgaccccgacctcgtgtggggcgggggcagatgtcacttgggccaatcgagagcccaggtgatggggaaagcaggggtgtgatatctgtcctggaaaactgggcagctgctaccgtggattgacggatctccacgaaagaagggaatgcgaccatgcagatcaccgtcaagaccatcaaagatcatcgggttcgcactgtccagaccgccatgagcagcgccttggggattggttcccaggtagacatgctcgcccccggcggttccaccagctcgagttccggttcatgctgctcgtgctcgacctgcgcggtagtggcgcagcctcaagactgaacggctggtcagccccaggggcgtggcgctcatcgcgtcacgccccttctattcgctggacagggtgcgcgagctgaggaacatcgcggtgtgtgcgatgacgaggggcaggagcaagtctgtgcgggttgccaagtagccctgcgcgatggccatcacgctggccccgacggcggcgaagacacctccgatacgtcgcttcatgccgccgaattgcatcaggacgaataggactcccgcggtccacatccctccgggcatgcatctgggaaagatgaaccggaagatgatctcttcacaggagagctggagtactagcagcgtagcccccacggggagactcacctctactgacagacggatcgtcttcatccacccacccgagctggcatcgaccatttcggtggccatgcgcgaccggtggcctcgtgcctctcgctgcgtgtcgatccagccgagcagtccgtggacgctctccgctaggactcctgacgcgacagtctcaccaattcctaagcccacggcgaggaccgcgacgcccccctgcacggcaggctgtgtgacttggtggtcccaccaacccgccggcaggaccatgcgtgcgaggctgcacacgagcaggaggtggagggtcacgacgagcgacatctggaataccgcttgccgttcggcgatggtggcgttgggaaagagcggtaggccggcacgggcagcggcgctcgacagcttccgcaagagcggtttggagacgaagtagtaggcgacgtacagcgccagcgctgtcgcgatgatgatcatcggtctgccaccgagctgacccgccgatagccgtttctgttccaccaatactggctgttgtagatcaggtggcccagaacacaggcccagatcccccagaagatgaacaggatagtccccaaggcggcgagcgggatcttggagaggacctgtccccgtccgaacaccgagtggccgcaagcaaacaagagtgctcccacagcggtgagcgcgagccaggccggggttgctcgcagactgatcaccgggaccccgacccggaagccgacctcttctcctacagcgatgactagcaactgccacagcggcatgttctgaacggagcgcgcgactcgggctcgagtcacccacacgggctgttgagcgctcacatcaccactcaggtaccccggtgaggcacttcgcttagtactggggcccgatgtgcgagcattcgtgatgtgtcgcaggatccggttgtcaagccaagaggccagcagggctccggcgacagtgacgggtagcccgatcagcacgaggccccagccatgcggtgccgagaggtttctggccggcgtgcacgcgaggcaggcaaatgccatcactgccagcactacgacgtagatggtcgcataattcgacttgcgggtgacgttgccgaccatcttggccaaagtcgctggggaccagctgatgagtgcgatggtggtcagcaggaagcaggaccagacagacatccggcgcactcaggggtatgggtgcggctgtgggttttggaaaccgccatatgcggcgtagcgggggtgtgcccgcatgggtgcgctgggcagtgacagggcgagcagcccaggcgcccagagcctgacacagtgcagtcccagcccctggatctctatggtggtgaaatcttcgatgtacaggggtgacacacaggtgatgctgttgaccacgctctttaccagttccgcccccgtgtgggtgtcgtcaggtggcaggtcttcggcttgggcaatggtgcccgcgtcgaatttcgccacaactgattgcgcggcctgatagttcctcgcgtagtaggagacgttcgagtcgaggtcaagcatgtcctccgtggacatactggacgcgtcggcctcggcgtcgaaagacgtccataccgcgagcatccgaaccccgctgcactcgagaaacgccttgtacatggctgcttccagacccgcgtctgcacctaggccgacggcgacgaggggaagttggttgccactaccgaccatcatgcatgccacggtgaaatgcttgagcccgggagtcggaagccagtagaaacgcagttcgtggcttcggcccgctgcacgttccacgagccgctggatgcgctggaggcggggtccttcgacgcggatgcgcacaggtgacgaggctccataccacaggcccatcgcggcatctacctggatcaattcataagccgcggacagcgttgcggcgacgcgtgaagtgtggacggcggtgccggtcgtcacggccgttcccagccacggctcaccgtcgtgccgacgggggttgtaacccaggtaaaagaactgcgccgggatccactcctgccgggaggtcccgacacggggagtcttgacccatgtcatgggcaagtcgtcgcgataggtgtcgaacgcacctccagccactcgttgcgcgaagccgaatgcgcccagatcgagaacttcgtcctcggtccgggcgaggagttcctgacgagtcgcccagcgccgttcgaagggactatggagaatcccggtacccgcgcagtagcgctcgacggcctccgcgtagaccttgatctctgcctcaaactcgttcagccccaccccaccgatgtggtagctacccggcttggggtcgggccggtcaagcagtgcgtgcatccccgtgagttccccaccgttcacccgcacgcgggggccgagcgcggggtgcagcgagtagccgacggaagtcaccagcccgcatagcgggctgtaggtgcgccgcctgagccgggctgcggtctcgacggggtcgctatcctggcgaagcttcatcgctcgccccctgccgccagccactcacggatgtcgtagtacaggtccggagcggtttcaacctgcgctggtgcatcaaaacgggacataggtaggacgtcgttgtaggcgatctccatcgtcggtatgtagaccgacaacactttgttgcgcgtcgtgttgaggccgttgcgggcgatgctgacagcctcatgcgcgacgtgcgcggccaagatcgcgcgcaccgacgctgccacggccggcgctccggcccttacgcggtcggcagcggccacccgcatccaggacaggtagctctgccgttcgcgcaggttcatcgcgacccgctgctcgaaggtccggtaggacgaggtcgcaccagggacgacgtagggacccacgtacaaggccggcccgtctacagctgcgtggagccacgacaggtgggcgcgtcgggcgaacaggtcaagggcgcgcagcatagccgggttgttctgcgccagcgctaccacaaggagtggctgcaggtccggcgccgaacccagcaacgccaacatctgggaggcctcctgctccatgtgcaactcgtcggccgactgctcaagccgcaggcctgcgaagagggtggctgatggctgcgtgtcgtcagcgaggacggtagcctgcagcccctctccctcgagaatctgctggatatcgccggcgaggagcgcgtcgtcgctgaatacccacaccgggcgcgtctctctacctccatccatcttgtcctcaacgttttcgaccagcgcaccgatcgatgctaggtgggccatcacgtcgtcaagggccgcgcgggtcaatccgggcacccgggacacgatctcgggcggctgcagtccttggctcaacaagtccaaggccggccacagggtcccggtggcgtcgtcgtcctccagcgttgtgctctcggcgttccagacgcctcgacggaactccaccctgtccatcgagtaaggcaccatcatgaggcccggtgaaatgtggttggtcactttggctcctgtacagcctaggcttggacgcccacggtcatggtgtgggtcgcggtttggaaaatcccgtcgaggttgagtgcctgattgagttcgtcctcgtagaagcttgaggactcgactgaggcaagaccgagccccgtgcagaccaagttgatctgttgtgcgatcgccccgacttcttgaagggcgaacctcaaacccctggctccgtacttccgcatcgccctccacggcgagatgacgaacaccaagtgcactccggccgcatccgattgctccacggccggctcgccggccatcgaattcctcacgccgcgacagccctcttcaccggtcacgggcaccagtcgatcgatgaccggcgagtagcggtagacgccgcgactcaagccggacacccgttgtgcggacatgaagatagacacgggatacagccctccaccagacgggacagcgcgtacattataccgcacgatatcaccgctcgaacgtgggacatccacgtgccccgtcacaccggcagcacctctcagaaacgcagctacgtcacgcaggtctagggattcgccggtgtagttccgtccgctgcgccggcgggcgatcacttgctcgaggggtgcgcgcaccctgctggacctgggaagttcgatcacatcggcagcgaacgtgtcgcgatccatctgtccgtacgtaacgatcatggggtcaacgaaatagtcgccgaccgagacgttgaactccatatccccccgggcgatgcgcgaggcgagcaagaagtctgcagctgcgttagacagccccggcccatcagtgttgtcgcagcggaactcgtgggtccgaaaccccacaccttccgtgcccgggctctgcgctcgatacgacgtgatcgcagaactagccttccttaaaccgcccggagtagctaccatgaccgtcccctctgaggtctcccgaacacttgcgacaatagcagcatgtgggggcagccgccagaggcgggcatccttgtctcgacaaccattgacctccggattcgatatgtgcataatcatagtcgtgccaacacgaaacgtgtacgtctcggaagacgacctagacctgttcgccgaagccaccgagatcgctggaggcctgtccgcagcggtgttggaggccttgcgcagctacgtagacaggcaccatcgcgcggccggcggattcgacgagatcgagctggagctgcagaacgacggtatcgaccaccgtgtcaccttcatgggtcgccgcctgatacacatccgccgtccagatcccgagggaacccgcatagacactgtctacttgaccgccaaacaccaattcgccgttgccaccaaaatccaacgacggctgccagactggacggccggccacgagcacatctggtccgacccggagacctggaatcgggagttctggatcgcaggtgacaagacgatggccgtgtatcccagccttgacaaactccgcgaagctgaccccaatgtggccgaacgcgccgaggccgcggtcaaaatcccgccgttcgaggtcctggacatctgatgacagaatcatcatcttcccggcggcaattggcaatgccggtgctgtcagtcacggatctagccaagaaatacgtggttcatggcggctacgaggtcccggcactcaacggtgtctcgtttgacctgcacccgggagagatgctgggtttgttcgggccaaacggtgctggaaagacgacgctggtcaggatcatcgcgggcctcttatcggcagattctggagacgtccactggggatcggatcaaggtcgggccaggttaggctacgtgtcccaaaagggtggactgcagtacgggctcacgtgccgggaagagatggtcttccacgcacaatgcttcggccagtccgccaagcaggcccggactagcgtcgacgaggtcgccgcgatgctgcactgcgattacctgatggagtgggacgtcggaaggctctccggtgggcaacgccgaatcatcgaggtagggctagcactcgtcaatcaaccatcggtcgtcctgctcgacgagcccaccctgggcctggaccccgcaacacgcctgtcgttgtggcaaacggtaaagtcggcacgccgtgagaccggtgctgccttcctcgtcaccacccactacattgacgaggtggccgagcacctgtccaacgtcagcgtgatcaaccacggaaccgtcgtcgccaacggctcgccagcgcacatccgagaaatgttcgcgaccggggaagtaacgctcggcgtggccgaggatacggtggacagtgcggtggacgtgttggctgggaccgcgttcgaggcgcaccccaccgaaaccgtcccggggatcgtggtcaggtccaggcatcccgacgtggacgcggccaagatcatcaccatcctggctggtcatggcatctcggtggactccatatccgtacgcgaggcgaccttggaagaggcgtttctcacgatcacaggcagtcgagacccggagaggcaaatcccatgaacacttgcttcaggcgatatgcggcgatgtcgctgagagcgcggcgtgatttggccctgacattcatccagcccctcgtctacctagccctcttcggaccgctcttcgtcacgacgatgaagatgtcgcagagagctaccgccgctacgggttactccctatacatcacgggcctgtccatccaaatggccatgacgatcggtgccttcgcggggctaaccatcatcctcgaataccgactcggcatcctcgaacggatctggagcacccccctcacggggagcaagatgatggcggggcgaatcgcgcgcgacgtcgttatgatgatgatgccgatactggtcgtcttcatcatcggcctggtgctgggaacacgccccagcccactgggcctggcgacctacttcgtgacagtgctcggcacaggagccacgttcgccggggtctcctacgcggtggcactcagaacgaagagcgaggcagcgctatccgcgatcttcaacctcatcctgctacccatcctcctgctgtcggggatcatgctgcccatgtcgttcgcaccacactggatcgccaccgctgcccacgtgaacccgttgtggtacctggtgcaaggcgcgcggaaccagttcagcgttctagggctcgtggcggcggccccatggagttgggctgtggccatcgtcatgtcagccgctgccttcggctgggcaagccacgaattcaacaagaggcgctgacacaaagaatggtgccgggaacccaggtccccggcaccaccgagtgcactcgcgacgtcaacgcaccgttgcggtcactgcgcaggtcgagcacgaggacgacgagcccgcgctgctgcaggtcgagccgccaggcgcgagcaggtcgacgttagcgtcggcgccgccgaagacggacgtgacggccggctgagaggtgcggatgcggtgctccagcgaggaggtggtggtgagtttcatgggaggtgctcctaggagtgagacgagaacaaaccctagcgataggttagcagtccgcaaccgactccgggaatagtagaagcgcgcatccgtagcggaagaccttagcctgattacagtgaccctgttcgcgtctcaacattattccacacccccgagcagcgaacgacaccgcgatgatgatccgtcgcctctccaccgaagaactccgcgcccacatcgcaccgggccgccgtcccgtgcatcagacctgccgtcaacgtcggccatgaagctgggaaggtggctctcgtctaggagcagacgcgggacgcctcctccaggttgggccggggaagtgtccggttcttgatgtaggtggcggtccctattgatgggcgttgaccgtgggaatgcggtcggcgaagggggtggcgaacccgttgagcgcaggcttccagcgcatgcatcaacgctgtctgccggccaccggcaagcctcacccgcccgtcatggccatcatcgaggtgccggtgaatcctcgacacatgatcccaactcccccggaggggcttccggggctgttcagccaccagatcagccaggcggcgagcccgactctgccacccggaccctgcagagcgtgcctgctgccgtcgtgtcgtgtcgggccagtgggccaccagatcggccacatccgtcttggcccatct

SEQ ID NO: 114 - DNA, 16491 bp, Propionibacterium acnes
gtgttccagtgcctcgcgggcgtgatgttcttcttcggcaccttcttgccacatgcttcgcgcttcagcctcgccatccaagcgaacctggactgtgaacgagtcctcatcgggtccgtcctcattccacgcggcaatgatcccacgggcctcgtctgcgacctgactcaacttcatcgcctgcccgacagccccgagagccggaatctcgaacacccagatattcgcctcagccgagacctcacgatgggcgatcacttcgtaggtcgtctcaccttctactgtcgtgtccattacttccactccttcggaattttcacgcctgctcgctccagctgtgccaggacaccaactgacgtcagctggtgtcctgctggtatcgatacgcgcccggctccgccggggcgtccccagatttcatggcttcccttggcgttccgcagacgggcccatccttgagaacggagcagcttgaggacgtccttagttttctgcggtttcacacatcatagtatagccccacttaacttgtaaactaagcccctgtttacattttagttggtgcatgtgatccctgctcttatgacgtcgcccgacctggcgccttagacatgcactgttcatcctcaaccacactcaccgtcacgggtccgaaggcgaggtctatcaccattcgcatcgatgaagttgaagcaggatcgtccgcatcacgcactgccgatccggacagacgccaccggccgtaccgactgtttacgatctgccaccgcagactgctgccataaccgctatcacctctgatagtacttttagtactatcagaggtgattcaagattctcctgtcgagcagccctacagtcacgaagtcctgcgatcgtcatcgcttaaggcagacggatggccatcggggaccactcgcaaagcaggggcgatcagcaacagtgatgtgccatgagcaagtactggtgcaccggctgtttactccgcccctagataaaccacgggtgcaggggtggacaccacaccatgaccgatgtggtgcccaccccatggctcacaggcaggccctatcgccgggagcactgctgcagatgaggctcagtaacctgccatgtctcacctggggccaaggtgccaagctccccacggaatctcaggcatcggaaaccagcagccgaacttccacagcatgagcgccctacgaaaaagcaggccgccgacggttctcaagaactcgccggcggcctgcatcgccactcgaactgtaaccgtggtccgaccccgtgcacaggtaagctccacactcccaccaggcatggccgaggcagtaccaagttgccgtggcccatcggcagatttggttaaattttgaaaagtcatatagactccttctgtaaatttttaaatctcataggactctcgccatcgccagccagcttcgacaggagtcccgatgtttcaccgagtgaaatatcggcaccgtttgagttgacctaaagctcaaaagatgctagaatccatcttaccccgttaggggcgttttgtcaaacgcccctatattgcgtgtcttcgcgcgtcgtagcgctgatgctgcgcctgtgtcgactatccgtttgtaagtactttcgatgacaccagcagtggctactcatgactggtgcgtgcgggtctaaagcagcagggaaaggaatcgcagtagaagccgcttgattcctatcacccctgatggtactatcagtactaacagagcagggcttactcgatgcgtgagaatcggggacatgctgagcctctcgtaggtcattggcctgctgggcgtcagtgtggcgcggttcgatccagtgaactctatcagctctgttagtactgtcagagttgatatattcgaccccaggaggagcccatgagttacatcgttcgcaccggaaatttggtcgacacccccgagctgcgtgagggagagcatggcccgtacacctacgctcgcgtcatcgtgtccgatcgcattcgccaggaggacggcagctacgtcaacgggccagcgatcgcctacgacgtcttggcgggtggcagccaagccgtgaatctggttgaagccgccaaggcgagcggcaacatccgcatcatgttcgcgggccgttaccgcgtcaccgagtggcggggtgagcagggcactcgtatccagcatgaggtccgagccgacgaagtgagcgtgagcctgctcggtcagagggtgaccgtggagcggcctcgaggtgacgtggcatccaaggagagcacgtcgttctgattgagtccgggggcacggtggtcgccgtggtaaaccgtgcccctgacagtactattgacactattggaggtatcagtgtgactgctcaaattttcgccttgtgcaaccagaagggtggcgtcggaaagtcgacatcgacgtttcatctggcccgtgccgcggtgttgcgtggccagcgtgtgcttgtcgtcgacaacgacccccagggcaacctgacgtctgtcgcggccgccgagcccgtgggggaggatcaggcggggctggccgatgtgctcagcgcgcgtgctccagagaccctccgcgatgtgatcgtgccgggaatctggtctggcctcgatgtcgtgccgacgtctggcatcacgctcggctgggtgcgtgacgaactcgtgatcgccggtgccggccgagaaggccggctgcgggaggccctggccggcgtcgaggacgactacgacgtgatcctgatcgactgtgctccatcgctcgatcagctcacgatcaacggcctggtggccgcccagggtgtcatcgtcgtgacgcactcgaagttgtggagcgccaacggcctcgcccagctgctcgacaccatcgacagcgtgcgcagctactacaacggcgcgctgcgcgtggcgggcatcatcgtcaaccagcacgaggagaacaccatcagcgggaaaacctggctcgacgagctgcatcaggctgccgagtcccggaagctgaccgtgcttgacccgccgatccccaagcgtgtcgtcatcgccgataccgtcgaggccgcgcgcggtctcgacgagtggggaagtgccgaggcggccgcgctcggccagttgtacgcccaccacctgacctgcatcgaaggagccctgtgatgacccgtccagccccccgaaagtcctcattgagcggatcaactccggtcgccccgccggctcagacggcgccggcaccgtctgccgcacctaccccccacaaggccgatgagtcacagacgagcagcaccacgaggaagtggcggcacaaggtgtcgttctaccaggacccggccgacaccgaccgggtgcgcggggcgatcctttacacgatgacgaccgagggcaaccggaacctgagccagttcgtcaacgatgccgtcatggccaaggtggtcgagctggaagtcaagtacaacgatggccagccattccccgctgtgggagcccgaggactaccccagggcggtgcagccgccgccggtgagtagaggaccatcgaccgtcgggggcttcaccatgcccccgaccctcggtcatcctgatcctcttgtcgatggtggtgacagtgggggattcacgcctcgttcagatcagaggaagtctcaccgcgtgattagtactatcaaatctgacagtactaacagagcagatagggttccctaggtcgagctgtatcacgccgacaaccagtgagccagtgatctacgaggggcgcaatatgcacccgatcggtagccgcgaaggcctcgccctgccccgatagtactatcaccactatcaatggtgctagtggtgagtttcttccattgatgacaacagcacagtgctgccgtctgtgtgcgggccaccagcccgcacacagttgccgtcgaggacgttgttcatgctctgtggtggccggtcctgagggcggctcgcaggatctcccggcgctcacggcgacgagcctggtagccaaggtctgcatgttcggcggcgagacgggctttgagggttgcggcttctgcacggcggtggagttggtcgtcgatgagttgggcgcgggccagacgccgcttatgggggttgtcgtgggtgaggggggcgtcgaggctgccgtcgtgggttagggccagggctgctcgttcggcgtcgtcgaggccgatgtggtggacggtcacgggtgcggtggtgacgtcgaggatgtccaggtggatgttgtggccgccgccgggggcttcggggaagtctggtgggctggcctggccggtgtcggggtcataccaggacaggccgatgatctcggcccagggtgggggcgggcagacggctcgcagaagggtgtgggccaggaacgtgttgcgggccatgatgcctccaagggtgaaaagcagtcgagtagcgatgacggcggggtagccgtctgctgggctgaggccgaccgggcccatgtcctcgatgctcttgtgctgcggccataccccaaagctaccaaacagtctttttaatctcaaagatacaaacagtgcttgacatattatctgcagcgaaagatactttcatcatggtggctgatcatgattacgcgactcctgacgatgagtggatgacacctcctcaggtggcccgtgtgattccgaacaccactgctcaggctgtccggcgctgggctgaggagggtcagcttcctggggcgtttcgtactccttctgggcgttggcatattccgtggtcggctgtggtgggcatcatggggtttgatccgcgtgagtccgcatcaccgagtgatcgtcaccagagctgacagagtcgtcgatgagctttcgagtgcagagctgatggcacgacggtctggatacttgtggagatgagagacgaccacatccagtcatggtcggggtacaccgaggggcagattcagcagtgctggcacgatgaggttgcccctgccattgactcgctcatggagcaggtaaggtctgttgccgagactcctgtgccgccgggttcgagattttacggcgatgagcagtgggccaagccttttcatccgtctactgcgatctgcggttcaatgggtccgccagcgatcacttgcacgcgctgaagctcctcgtctgggaagcgaacgtccaccatgtctatgcgccgtacacccttgctcgtgcatctattgaggcatcgtctactgctgtgtggctgttgagcacgaagacgcgcggagaacgtgtgctgcgagccttgcgatggtacgcgcaggattgtcacgactcgtgcaggttcatggatgatgagcagtatcgtgaccacctattgcggcgcattgaggggactgtcgctgcgggaaatctcgactcgcgcgctgctaggaaacggtaccgtgcaaccgatgttgtcgatgaggctgatcagctggttcccggaactctgagggcgtggcgagctttttctggtatggcccattcccgtatgtgggcatccagggggctgctcgacatggaagtgctgtccagtggccaaggaatggttacggcgaaggtgacgagcggatcggcccaaatcctttgggccgtcgtggcagctctgaatgttgctctcagtgccgctcgcttgtggcgtgattcgatgtgctcaccgtttgctgttgcccagtcggtagacgcgatgccagaggcgtttcgccgccctgtttagggtctgatcggggtagtgggtgttcacggggtcccaggttggccatggggcggcttggtgatgtgagttgggttgtgtggcagcctgggtgttgggtgtggcttcgttggccacgaaggcatgctcttccttgtgctgggacttgagtccccagtgctctcccctttgctagtggggggtggggtccccggaggtaggtcctccggggactttttctatgtctgtccgtgccccaggatttcgtatctaggcagtaccaattttgggttagttggaggtttctttggtaatggacagggtgagggtgatgaagaggtggccgtccttggtggcagaaattttctcgaacttcagctgaatgttgttatcagccactatctgttgggcggtgaggtgctcggagagcttctggaatccttcgcggatccacaggttgtaggggttggtgaccgagaccgaagggtatgggtcgaccttcagcgtcaggactggctggtctgggttgagggagttgatcttcaccagtttggggtaccggtcgcactcatgtgtctcttgtgttgggggccagcagtcgggggcccattcctcccagtggtcacgcatctcacgaagtactttcctgcatctcagcctctgcaggagctcgcgcgccaccgatgggagggctgccatgatgagggcaaggactgcgaacccgatgatgtaattgaccgtgtccctcgtcacgccgttcttgccgaggattccgatggcgaacgcgatgacgacaccgcccaggcacaggtgcatggggtcatgctgtgatggtttttcttcttcagcgactggtggggctatagtcatgtgtgccccttagtactaagtgatactggtgggttgcttttccccggtggccgtgtgcaagacggccaccggggttttccttcatgttcctgattttatctgcccggtgtggcgttttcatctttgtgtgggtggttcgcctggggtcttggagtgtggtgacgcggtgatggtcacggtgacggtgactgtggcgcgtggcgggtgaggtggttctttcctggtctggtgtgtggcccaggtgagtgtggtgatgagggccagggtgaggatgatgaccagggtggggagtagtttgtctggccggtgtcgccgggcttggtggcgcggcatgtttttccagggtgtgtctccgaacaggtcgtcgtcggaggggtcgtcgtggttcatagggtggccttggcgatggtggtgggcgagtttggtccaggtgatggtgccgtcggaggcgatgtggcggtcggcgggcagggtgtggacggtccatccggcgtcggtgagggcggtggtgaaggatttcttgatggatcgtttgggtaggtcgatgggggcgtgggtgccgacccagatgcaccggtttttgaggtgggtggcgccgaggtggttcatgtcgcggaccatgttttgggtgagtgtgagggtgtcggggtcccattggacggggatgatgatgtggtctgcgatggtgatggcgtgttgccaggcggcgtcgaggtcgttgtttccggtgtcgaggatgatgacgtggaagcggcttcttagggcggtgatgatgcggtcgaggtcgtcggcggtggggggtgtgatgaggctgttgtggttgtcggtgatggtgggtaggcatgtgatggtggcccagccttctggttgccaggagatgtaggggtcgaggtcgcggggttgggaggcgaatcctgggtgacgggctgcgcgggcgaggtcgatgacggtgttgtcggtgtggcggggtgcgcgggtggagagggtgccgcgtgggttgatttccacgacgacgatgtcgtcgtgtcctgctgtggtggcgagggcttgggcaaggatgacggccagcggggttttgccggtgccgcctttgaggttggcgagggtgatgatgtggtcggtgagttgggcgggtgcggcggtgtggtgagggttggcggtgaggttggcgatggtgaacagggcatcgagatcgtcggtggtgttctgctcggtgggttgggggtcgccggagatgatcgggtcggcgcggcgcggctgccatgccggcctcaccactgtcacgaccaccacgggtctgctggcgctgtgtgggtgtcgtcggcgatgactcacgatcggcagtctcaccatcgtctcggtgatgctcggctagcgctggacccggtcaagttcgggccggctcacccagtggtgatgactcggtcacagaaccgctgccggtcgttatctcggacgtctcgactcctccagtcctgatgggcgttggagccacctacacctactctcagaacgaccccgacctcgtgtggggcgggggcagatgtcacttgggccaatcgagagcccaggtgatggggaaagcagggtgtgatatctgtcctggaaaactgggcagctgctaccgtggattgacggatctccacgaaagaagggaatgcgaccatgcagatcaccgtcaagaccatcaaagatcatcgggttcgcactgtccagaccgccatgagcagcgccttggggattggttcccaggtagacatgctcgcccccggcggttccaccagctcgagttccggttcatgctgctcgtgctcgacctgcgcggtagtggcgcagcctcaagactgaacggctggtcagccccaggggcgtggcgctcatcgcgtcacgccccttctattcgctggacagggtgcgcgagctgaggaacatcgcggtgtgtgcgatgacgaggggcaggagcaagtctgtgcgggttgccaagtagccctgcgcgatggccatcacgctggccccgacggcggcgaagacacctccgatacgtcgcttcatgccgccgaattgcatcaggacgaataggactcccgcggtccacatccctccgggcatgcatctgggaaagatgaaccggaagatgatctcttcacaggagagctggagtactagcagcgtagcccccacggggagactcacctctactgacagacggatcgtcttcatccacccacccgagctggcatcgaccatttcggtggccatgcgcgaccggtggcctcgtgcctctcgctgcgtgtcgatccagccgagcagtccgtggacgctctccgctaggactcctgacgcgacagtctcaccaattcctaagcccacggcgaggaccgcgacgcccccctgcacggcaggctgtgtgacttggtggtcccaccaacccgccggcaggaccatgcgtgcgaggctgcacacgagcaggaggtggagggtcacgacgagcgacatctggaataccgcttgccgttcggcgatggtggcgttgggaaagagcggtaggccggcacgggcagcggcgctcgacagcttccgcaagagcggtttggagacgaagtagtaggcgacgtacagcgccagcgctgtcgcgatgatgatcatcggtctgccaccgagctgacccgccgatagccgtttctgttccaccaatactggctgttgtagatcaggtggcccagaacacaggcccagatcccccagaagatgaacaggatagtccccaaggcggcgagcgggatcttggagaggacctgtccccgtccgaacaccgagtggccgcaagcaaacaagagtgctcccacagcggtgagcgcgagccaggccggggttgctcgcagactgatcaccgggaccccgacccggaagccgacctcttctcctacagcgatgactagcaactgccacagcggcatgttctgaacggagcgcgcgactcgggctcgagtcacccacacgggctgttgagcgctcacatcaccactcaggtaccccggtgaggcacttcgcttagtactggggcccgatgtgcgagcattcgtgatgtgtcgcaggatccggttgtcaagccaagaggccagcagggctccggcgacagtgacgggtagcccgatcagcacgaggccccagccatgcggtgccgagaggtttctggccggcgtgcacgcgaggcaggcaagtgccaacactgccagcactacgacgtagatggtcgcataattcgacttgcgggtgacgttgccgaccatcttggccaaagtcgctggggaccagctgatgagtgcgatggtggtcagcaggaagcaggaccagacagacatccggcgcactcaggggtatgggtgcggctgtgggttttggaaaccgccatatgcggcgtagcgggggtgtgcccgcatgggtgcgctgggcagtgacagggcgagcagcccaggcgcccagagcctgacacagtgcagtcccagcccctggatctctatggtggtgaaatcttcgatgtacaggggtgacacacaggtgatgctgttgaccacgctctttaccagttccgcccccgtgtgggtgtcgtcaggtggcaggtcttcggcttgggcaatggtgcccgcgtcgaatttcgccacaactgattgcgcggcctgatagttcctcgcgtagtaggagacgttcgagtcgaggtcaagcatgtcctccgtggacatactggacgcgtcggcctcggcgtcgaaagacgtccataccgcgagcatccgaaccccgctgcactcgagaaacgccttgtacatggctgcttccagacccgcgtctgcacctaggccgacggcgacgaggggaagttggttgccactaccgaccatcatgcatgccacggtgaaatgcttgagcccgggagtcggaagccagtagaaacgcagttcgtggcttcggcccgctgcacgttccacgagccgctggatgcgctggaggcggggtccttcgacgcggatgcgcacaggtgacgaggctccataccacaggcccatcgcggcatctacctggatcaattcataagccgcggacagcgttgcggcgacgcgtgaagtgtggacggcggtgccggtcgtcacggccgttcccagccacggctcaccgtcgtgccgacgggggttgtaacccaggtaaaagaactgcgccgggatccactcctgccgggaggtcccgacacggggagtcttgacccatgtcatgggcaagtcgtcgcgataggtgtcgaacgcacctccagccactcgttgcgcgaagccgaatgcgcccagatcgagaacttcgtcctcggtccgggcgaggagttcctgacgagtcgcccagcgccgttcgaagggactatggagaatcccggtacccgcgcagtagcgctcgacggcctccgcgtagaccttgatctctgcctcaaactcgttcagccccaccccaccgatgtggtagctacccggcttggggtcgggccggtcaagcagtgcgtgcatccccgtgagttccccaccgttcacccgcacgcgggggccgagcgcggggtgcagcgagtagccgacggaagtcaccagcccgcatagcgggctgtaggtgcgccgcctgagccgggctgcggtctcgacggggtcgctatcctggcgaagcttcatcgctcgccccctgccgccagccactcacggatgtcgtagtacaggtccggagcggtttcaacctgcgctggtgcatcaaaacgggacataggtaggacgtcgttgtaggcgatctccatcgtcggtatgtagaccgacaacactttgttgcgcgtcgtgttgaggccgttgcgggcgatgctgacagcctcatgcgcgacgtgcgcggccaagatcgcgcgcaccgacgctgccacggccggcgctccggcccttacgcggtcggcagcggccacccgcatccaggacaggtagctctgccgttcgcgcaggttcatcgcgacccgctgctcgaaggtccggtaggacgaggtcgcaccagggacgacgtagggacccacgtacaaggccggcccgtctacagctgcgtggagccacgacaggtgggcgcgtcgggcgaacaggtcaagggcgcgcagcatagccgggttgttctgcgccagcgctaccacaaggagtggctgcaggtccggcgccgaacccagcaacgccaacatctgggaggcctcctgctccatgtgcaactcgtcggccgactgctcaagccgcaggcctgcgaagagggtggctgatggctgcgtgtcgtcagcgaggacggtagcctgcagcccctctccctcgagaatctgctggatatcgccggcgaggagcgcgtcgtcgctgaatacccacaccgggcgcgtctctctacctccatccatcttgtcctcaacgttttcgaccagcgcaccgatcgatgctaggtgggccatcacgtcgtcaagggccgcgcgggtcaatccgggcacccgggacacgatctcgggcggctgcagtccttggctcaacaagtccaaggccggccacagggtcccggtggcgtcgtcgtcctccagcgttgtgctctcggcgttccagacgcctcgacggaactccaccctgtccatcgagtaaggcaccatcatgaggcccggtgaaatgtggttggtcactttggctcctgtacagcctaggcttggacgcccacggtcatggtgtgggtcgcggtttggaaaatcccgtcgaggttgagtgcctgattgagttcgtcctcgtagaagcttgaggactcgactgaggcaagaccgagccccgtgcagaccaagttgatctgttgtgcgatcgccccgacttcttgaagggcgaacctcaaacccctggctccgtacttccgcatcgccctccacggcgagatgacgaacaccaagtgcactccggccgcatccgattgctccacggccggctcgccggccatcgaattcctcacgccgcgacagccctcttcaccggtcacgggcaccagtcgatcgatgaccggcgagtagcggtagacgccgcgactcaagccggacacccgttgtgcggacatgaagatagacacgggatacagccctccaccagacgggacagcgcgtacattataccgcacgatatcaccgctcgaacgtgggacatccacgtgccccgtcacaccggcagcacctctcagaaacgcagctacgtcacgcaggtctagggattcgccggtgtagttccgtccgctgcgccggcgggcgatcacttgctcgaggggtgcgcgcaccctgctggacctgggaagttcgatcacatcggcagcgaacgtgtcgcgatccatctgtccgtacgtaacgatcatggggtcaacgaaatagtcgccgaccgagacgttgaactccatatccccccgggcgatgcgcgaggcgagcaagaagtctgcagctgcgttagacagccccggcccatcagtgttgtcgcagcggaactcgtgggtccgaaaccccacaccttccgtgcccgggctctgcgctcgatacgacgtgatcgcagaactagccttccttaaaccgcccggagtagctaccatgaccgtcccctctgaggtctcccgaacacttgcgacaatagcagcatgtgggggcagccgccagaggcgggcatccttgtctcgacaaccattgacctccggattcgatatgtgcataatcatagtcgtgccaacacgaaacgtgtacgtctcggaagacgacctagacctgttcgccgaagccaccgagatcgctggaggcctgtccgcagcggtgttggaggccttgcgcagctacgtagacaggcaccatcgcgcggccggcggattcgacgagatcgagctggagctgcagaacgacggtatcgaccaccgtgtcaccttcatgggtcgccgcctgatacacatccgccgtccagatcccgagggaacccgcatagacactgtctacttgaccgccaaacaccaattcgccgttgccaccaaaatccaacgacggctgccagactggacgaccggccacgagcacatctggtccgacccggagacctggaatcgggagttctggatcgcaggtgacaagacgatggccgtgtatcccagccttgacaaactccgcgaagctgaccccaatgtggccgaacgcgccgaggccgcggtcaaaatcccgccgttcgaggtcctggacatctgatgacagaatcatcatcttcccggcggcaattggcaatgccggtgctgtcagtcacggatctagccaagaaatacgtggttcatggcggctacgaggtcccggcactcaacggtgtctcgtttgacctgcacccgggagagatgctgggtttgttcgggccaaacggtgctggaaagacgacgctggtcaggatcatcgcgggcctcttatcggcagattctggagacgtccactggggatcggatcaaggtcgggccaggttaggctacgtgtcccaaaagggtggactgcagtacgggctcacgtgccgggaagagatggtcttccacgcacaatgcttcggccagtccgccaagcaggcccggactagcgtcgacgaggtcgccgcgatgctgcactgcgattacctgatggagtgggacgtcggaaggctctccggtgggcaacgccgaatcatcgaggtagggctagcactcgtcaatcaaccatcggtcgtcctgctcgacgagcccaccctgggcctggaccccgcaacacgcctgtcgttgtggcaaacggtaaagtcggcacgccgtgagaccggtgctgccttcctcgtcaccacccactacattgacgaggtggccgagcacctgtccaacgtcagcgtgatcaaccacggaaccgtcgtcgccaacggctcgccagcgcacatccgagaaatgttcgcgaccggggaagtaacgctcggcgtggccgaggatacggtggacagtgcggtggacgtgttggctgggaccgcgttcgaggcgcaccccaccgaaaccgtcccggggatcgtggtcaggtccaggcatcccgacgtggacgcggccaagatcatcaccatcctggctggtcatggcatctcggtggactccatatccgtacgcgaggcgaccttggaagaggcgtttctcacgatcacaggcagtcgagacccggagaggcaaatcccatgaacacttgcttcaggcgatatgcggcgatgtcgctgagagcgcggcgtgatttggccctgacattcatccagcccctcgtctacctagccctcttcggaccgctcttcgtcacgacgatgaagatgtcgcagagagctaccgccgctacgggttactccctatacatcacgggcctgtccatccaaatggccatgacgatcggtgccttcgcggggctaaccatcatcctcgaataccgactcggcatcctcgaacggatctggagcacccccctcacggggagcaagatgatggcggggcgaatcgcgcgcgacgtcgttatgatgatgatgccgatactggtcgtcttcatcatcggcctggtgctgggaacacgccccagcccactgggcctggcgacctacttcgtgacagtgctcggcacaggagccacgttcgccggggtctcctacgcggtggcactcagaacgaagagcgaggcagcgctatccgcgatcttcaacctcatcctgctacccatcctcctgctgtcggggatcatgctgcccatgtcgttcgcaccacactggatcgccaccgctgcccacgtgaacccgttgtggtacctggtgcaaggcgcgcggaaccagttcagcgttctagggctcgtggcggcggccccatggagttgggctgtggccatcgtcatgtcagccgctgccttcggctgggcaagccacgaattcaacaagaggcgctgacacaaagaatggtgccgggaacccaggtccccggcaccaccgagtgcactcgcgacgtcaacgcaccgttgcggtcactgcgcaggtcgagcacgaggacgacgagcccgcgctgctgcaggtcgagccgccaggcgcgagcaggtcgacgttagcgtcggcgccgccgaagacggacgtgacggccggctgagaggtgcggatgcggtgctccagcgaggaggtggtggtgagtttcatgggaggtgctcctaggagtgagacgagaacaaaccctagcgataggttagcagtccgcaaccgactccgggaatagtagaagcgcgcatccgtagcggaagaccttagcctgattacagtgaccctgttcgcgtctcaacattattccacacccccgagcagcgaacgacaccgcgatgatgatccgtcgcctctccaccgaagaactccgcgcccacatcgcaccgggccgccgtcccgtgcatcagacctgccgtcaacgtcggccatgaagctgggaaggtggctctcgtctaggagcagacgcgggacgcctcctccaggttgggccggggaagtgtccggttcttgatgtaggtggcggtccctattgatgggcgttgaccgtgggaatgcggtcggcgaagggggtggcgaacccgttgagcgcaggcttccagcgcatgcatcaacgctgtctgccggccaccggcaagcctcacccgcccgtcatggccatcatcgaggtgccggtgaatcctcgacacatgatcccaactcccccggaggggcttccggggctgttcagccaccagatcagccaggcggcgagcccgactctgccacccggaccctgcagagcgtgcctgctgccgtcgtgtcgtgtcgggccagtgggccaccagatcggccacatccgtcttggcccat

SEQ ID NO: 115 - DNA, 13424 bp, Propionibacterium acnes
ccgcgcggggtctcgacgagtggggaagtgccgaggcggccgcgctcggccagttgtacgcccaccacctgacctgcatcgaaggagccctgtgatgacccgtccagccccccgaaagtcctcattgagcggatcaactccggtcgccccgccggctcagacggcgccggcaccgtctgccgcacctaccccccacaaggccgatgagtcacagacgagcagcaccacgaggaagtggcggcacaaggtgtcgttctaccaggacccggccgacaccgaccgggtgcgcggggcgatcctttacacgatgacgaccgagggcaaccggaacctgagccagttcgtcaacgatgccgtcatggccaaggtggtcgagctggaagtcaagtacaacgatggccagccattccccgctgtgggagcccgaggactaccccagggcggtgcagccgccgccggtgagtagaggaccatcgaccgtcgggggcttcaccatgcccccgaccctcggtcatcctgatcctcttgtcgatggtggtgacagtgggggattcacgcctcgttcagatcagaggaagtctcaccgcgtgattagtactatcaaatctgacagtactaacagagcagatagggttccctaggtcgagctgtatcacgccgacaaccagtgagccagtgatctacgaggggcgcaatatgcacccgatcggtagccgcgaaggcctcgccctgccccgatagtactatcaccactatcaatggtgctagtggtgagtttcttccattgatgacaacagcacagtgctgccgtctgtgtgcgggccaccagcccgcacacagttgccgtcgaggacgttgttcatgctctgtggtggccggtcctgagggcggctcgcaggatctcccggcgctcacggcgacgagcctggtagccaaggtctgcatgttcggcggcgagacgggctttgagggttgcggcttctgcacggcggtggagttggtcgtcgatgagttgggcgcgggccagacgccgcttatgggggttgtcgtgggtgaggggggcgtcgaggctgccgtcgtgggttagggccagggctgctcgttcggcgtcgtcgaggccgatgtggtggacggtcacgggtgcggtggtgacgtcgaggatgtccaggtggatgttgtggccgccgccgggggcttcggggaagtctggtgggctggcctggccggtgtcggggtcataccaggacaggccgatgatctcggcccagggtgggggcgggcagacggctcgcagaagggtgtgggccaggaacgtgttgcgggccatgatgcctccaagggtgaaaagcagtcgagtagcgatgacggcggggtagccgtctgctgggctgaggccgaccgggcccatgtcctcgatgctcttgtgctgcggccataccccaaagctaccaaacagtctttttaatctcaaagatacaaacagtgcttgacatattatctgcagcgaaagatactttcatcatggtggctgatcatgattacgcgactcctgacgatgagtggatgacacctcctcaggtggcccgtgtgattccgaacaccactgctcaggctgtccggcgctgggctgaggagggtcagcttcctggggcgtttcgtactccttctgggcgttggcatattccgtggtcggctgtggtgggcatcatggggtttgatccgcgtgagtccgcatcaccgagtgatcgtcaccagagctgacagagtcgtcgatgagctttcgagtgcagagctgatggcacgacggtctggatacttgtggagatgagagacgaccacatccagtcatggtcggggtacaccgaggggcagattcagcagtgctggcacgatgaggttgcccctgccattgactcgctcatggagcaggtaaggtctgttgccgagactcctgtgccgccgggttcgagattttacggcgatgagcagtgggccaagccttttcatccgtctactgcgatctgcggttcaatgggtccgccagcgatcacttgcacgcgctgaagctcctcgtctgggaagcgaacgtccaccatgtctatgcgccgtacacccttgctcgtgcatctattgaggcatcgtctactgctgtgtggctgttgagcacgaagacgcgcggagaacgtgtgctgcgagccttgcgatggtacgcgcaggattgtcacgactcgtgcaggttcatggatgatgagcagtatcgtgaccacctattgcggcgcattgaggggactgtcgctgcgggaaatctcgactcgcgcgctgctaggaaacggtaccgtgcaaccgatgttgtcgatgaggctgatcagctggttcccggaactctgagggcgtggcgagctttttctggtatggcccattcccgtatgtgggcatccagggggctgctcgacatggaagtgctgtccagtggccaaggaatggttacggcgaaggtgacgagcggatcggcccaaatcctttgggccgtcgtggcagctctgaatgttgctctcagtgccgctcgcttgtggcgtgattcgatgtgctcaccgtttgctgttgcccagtcggtagacgcgatgccagaggcgtttcgccgccctgtttagggtctgatcggggtagtgggtgttcacggggtcccaggttggccatggggcggcttggtgatgtgagttgggttgtgtggcagcctgggtgttgggtgtggcttcgttggccacgaaggcatgctcttccttgtgctgggacttgagtccccagtgctctcccctttgctagtggggggtggggtccccggaggtaggtcctccggggactttttctatgtctgtccgtgccccaggatttcgtatctaggcagtaccaattttgggttagttggaggtttctttggtaatggacagggtgagggtgatgaagaggtggccgtccttggtggcagaaattttctcgaacttcagctgaatgttgttatcagccactatctgttgggcggtgaggtgctcggagagcttctggaatccttcgcggatccacaggttgtaggggttggtgaccgagaccgaagggtatgggtcgaccttcagcgtcaggactggctggtctgggttgagggagttgatcttcaccagtttggggtaccggtcgcactcatgtgtctcttgtgttgggggccagcagtcgggggcccattcctcccagtggtcacgcatctcacgaagtactttcctgcatctcagcctctgcaggagctcgcgcgccaccgatgggagggctgccatgatgagggcaaggactgcgaacccgatgatgtaattgaccgtgtccctcgtcacgccgttcttgccgaggattccgatggcgaacgcgatgacgacaccgcccaggcacaggtgcatggggtcatgctgtgatggtttttcttcttcagcgactggtggggctatagtcatgtgtgccccttagtactaagtgatactggtgggttgcttttccccggtggccgtgtgcaagacggccaccggggttttccttcatgttcctgattttatctgcccggtgtggcgttttcatctttgtgtgggtggttcgcctggggtcttggagtgtggtgacgcggtgatggtcacggtgacggtgactgtggcgcgtggcgggtgaggtggttctttcctggtctggtgtgtggcccaggtgagtgtggtgatgagggccagggtgaggatgatgaccagggtggggagtagtttgtctggccggtgtcgccgggcttggtggcgcggcatgtttttccagggtgtgtctccgaacaggtcgtcgtcggaggggtcgtcgtggttcatagggtggccttggcgatggtggtgggcgagtttggtccaggtgatggtgccgtcggaggcgatgtggcggtcggcgggcagggtgtggacggtccatccggcgtcggtgagggcggtggtgaaggatttcttgatggatcgtttgggtaggtcgatgggggcgtgggtgccgacccagatgcaccggtttttgaggtgggtggcgccgaggtggttcatgtcgcggaccatgttttgggtgagtgtgagggtgtcggggtcccattggacggggatgatgatgtggtctgcgatggtgatggcgtgttgccaggcggcgtcgaggtcgttgtttccggtgtcgaggatgatgacgtggaagcggcttcttagggcggtgatgatgcggtcgaggtcgtcggcggtggggggtgtgatgaggctgttgtggttgtcggtgatggtgggtaggcatgtgatggtggcccagccttctggttgccaggagatgtaggggccgaggtcgcggggttgggaggcgaatcctgggtgacgggctgcgcgggcgaggtcgatgacggtgttgtcggtgtggcggggtgcgcgggtggagagggtgccgcgtgggttgatttccacgacgacgatgtcgtcgtgtcctgctgtggtggcgagggcttgggcaaggatgacggccagcggggttttgccggtgccgcctttgaggttggcgagggtgatgatgtggtcggtgagttgggcgggtgcggcggtgtggtgagggttggcggtgaggttggcgatggtgaacagggcatcgagatcgtcggtggtgttctgctcggtgggttgggggtcgccggagatgatcgggtcggcgcggcgcggctgccatgccggcctcaccactgtcacgaccaccacgggtctgctggcgctgtgtgggtgtcgtcggcgatgactcacgatcggcagtctcaccatcgtctcggtgatgctcggctagcgctggacccggtcaagttcgggccggctcacccagtggtgatgactcggtcacagaaccgctgccggtcgttatctcggacgtctcgactcctccagtcctgatgggcgttggagccacctacacctactctcagaacgaccccgacctcgtgtggggcgggggcagatgtcacttgggccaatcgagagcccaggtgatggggaaagcaggggtgtgatatctgtcctggaaaactgggcagctgctaccgtggattgacggatctccacgaaagaagggaatgcgaccatgcagatcaccgtcaagaccatcaaagatcatcgggttcgcactgtccagaccgccatgagcagcgccttggggattggttcccaggtagacatgctcgcccccggcggttccaccagctcgagttccggttcatgctgctcgtgctcgacctgcgcggtagtggcgcagcctcaagactgaacggctggtcagccccaggggcgtggcgctcatcgcgtcacgccccttctattcgctggacagggtgcgcgagctgaggaacatcgcggtgtgtgcgatgacgaggggcaggagcaagtctgtgcgggttgccaagtagccctgcgcgatggccatcacgctggccccgacggcggcgaagacacctccgatacgtcgcttcatgccgccgaattgcatcaggacgaataggactcccgcggtccacatccctccgggcatgcatctgggaaagatgaaccggaagatgatctcttcacaggagagctggagtactagcagcgtagcccccacggggagactcacctctactgacagacggatcgtcttcatccacccacccgagctggcatcgaccatttcggtggccatgcgcgaccggtggcctcgtgcctctcgctgcgtgtcgatccagccgagcagtccgtggacgctctccgctaggactcctgacgcgacagtctcaccaattcctaagcccacggcgaggaccgcgacgcccccctgcacggcaggctgtgtgacttggtggtcccaccaacccgccggcaggaccatgcgtgcgaggctgcacacgagcaggaggtggagggtcacgacgagcgacatctggaataccgcttgccgttcggcgatggtggcgttgggaaagagcggtaggccggcacgggcagcggcgctcgacagcttccgcaagagcggtttggagacgaagtagtaggcgacgtacagcgccagcgctgtcgcgatgatgatcatcggtctgccaccgagctgacccgccgatagccgtttctgttccaccaatactggctgttgtagatcaggtggcccagaacacaggcccagatcccccagaagatgaacaggatagtccccaaggcggcgagcgggatcttggagaggacctgtccccgtccgaacaccgagtggccgcaagcaaacaagagtgctcccacagcggtgagcgcgagccaggccggggttgctcgcagactgatcaccgggaccccgacccggaagccgacctcttctcctacagcgatgactagcaactgccacagcggcatgttctgaacggagcgcgcgactcgggctcgagtcacccacacgggctgttgagcgctcacatcaccactcaggtaccccggtgaggcacttcgcttagtactggggcccgatgtgcgagcattcgtgatgtgtcgcaggatccggttgtcaagccaagaggccagcagggctccggcgacagtgacgggtagcccgatcagcacgaggccccagccatgcggtgccgagaggtttctggccggcgtgcacgcgaggcaggcaaatgccatcactgccagcactacgacgtagatggtcgcataattcgacttgcgggtgacgttgccgaccatcttggccaaagtcgctggggaccagctgatgagtgcgatggtggtcagcaggaagcaggaccagacagacatccggcgcactcaggggtatgggtgcggctgtgggttttggaaaccgccatatgcggcgtagcgggggtgtgcccgcatgggtgcgctgggcagtgacagggcgagcagcccaggcgcccagagcctgacacagtgcagtcccagcccctggatctctatggtggtgaaatcttcgatgtacaggggtgacacacaggtgatgctgttgaccacgctctttaccagttccgcccccgtgtgggtgtcgtcaggtggcaggtcttcggcttgggcaatggtgcccgcgtcgaatttcgccacaactgattgcgcggcctgatagttcctcgcgtagtaggagacgttcgagtcgaggtcaagcatgtcctccgtggacatactggacgcgtcggcctcggcgtcgaaagacgtccataccgcgagcatccgaaccccgctgcactcgagaaacgccttgtacatggctgcttccagacccgcgtctgcacctaggccgacggcgacgaggggaagttggttgccactaccgaccatcatgcatgccacggtgaaatgcttgagcccgggagtcggaagccagtagaaacgcagttcgtggcttcggcccgctgcacgttccacgagccgctggatgcgctggaggcggggtccttcgacgcggatgcgcacaggtgacgaggctccataccacaggcccatcgcggcatctacctggatcaattcataagccgcggacagcgttgcggcgacgcgtgaagtgtggacggcggtgccggtcgtcacggccgttcccagccacggctcaccgtcgtgccgacgggggttgtaacccaggtaaaagaactgcgccgggatccactcctgccgggaggtcccgacacggggagtcttgacccatgtcatgggcaagtcgtcgcgataggtgtcgaacgcacctccagccactcgttgcgcgaagccgaatgcgcccagatcgagaacttcgtcctcggtccgggcgaggagttcctgacgagtcgcccagcgccgttcgaagggactatggagaatcccggtacccgcgcagtagcgctcgacggcctccgcgtagaccttgatctctgcctcaaactcgttcagccccaccccaccgatgtggtagctacccggcttggggtcgggccggtcaagcagtgcgtgcatccccgtgagttccccaccgttcacccgcacgcgggggccgagcgcggggtgcagcgagtagccgacggaagtcaccagcccgcatagcgggctgtaggtgcgccgcctgagccgggctgcggtctcgacggggtcgctatcctggcgaagcttcatcgctcgccccctgccgccagccactcacggatgtcgtagtacaggtccggagcggtttcaacctgcgctggtgcatcaaaacgggacataggtaggacgtcgttgtaggcgatctccatcgtcggtatgtagaccgacaacactttgttgcgcgtcgtgttgaggccgttgcgggcgatgctgacagcctcatgcgcgacgtgcgcggccaagatcgcgcgcaccgacgctgccacggccggcgctccggcccttacgcggtcggcagcggccacccgcatccaggacaggtagctctgccgttcgcgcaggttcatcgcgacccgctgctcgaaggtccggtaggacgaggtcgcaccagggacgacgtagggacccacgtacaaggccggcccgtctacagctgcgtggagccacgacaggtgggcgcgtcgggcgaacaggtcaagggcgcgcagcatagccgggttgttctgcgccagcgctaccacaaggagtggctgcaggtccggcgccgaacccagcaacgccaacatctgggaggcctcctgctccatgtgcaactcgtcggccgactgctcaagccgcaggcctgcgaagagggtggctgatggctgcgtgtcgtcagcgaggacggtagcctgcagcccctctccctcgagaatctgctggatatcgccggcgaggagcgcgtcgtcgctgaatacccacaccgggcgcgtctctctacctccatccatcttgtcctcaacgttttcgaccagcgcaccgatcgatgctaggtgggccatcacgtcgtcaagggccgcgcgggtcaatccgggcacccgggacacgatctcgggcggctgcagtccttggctcaacaagtccaaggccggccacagggtcccggtggcgtcgtcgtcctccagcgttgtgctctcggcgttccagacgcctcgacggaactccaccctgtccatcgagtaaggcaccatcatgaggcccggtgaaatgtggttggtcactttggctcctgtacagcctaggcttggacgcccacggtcatggtgtgggtcgcggtttggaaaatcccgtcgaggttgagtgcctgattgagttcgtcctcgtagaagcttgaggactcgactgaggcaagaccgagccccgtgcagaccaagttgatctgttgtgcgatcgccccgacttcttgaagggcgaacctcaaacccctggctccgtacttccgcatcgccctccacggcgagatgacgaacaccaagtgcactccggccgcatccgattgctccacggccggctcgccggccatcgaattcctcacgccgcgacagccctcttcaccggtcacgggcaccagtcgatcgatgaccggcgagtagcggtagacgccgcgactcaagccggacacccgttgtgcggacatgaagatagacacgggatacagccctccaccagacgggacagcgcgtacattataccgcacgatatcaccgctcgaacgtgggacatccacgtgccccgtcacaccggcagcacctctcagaaacgcagctacgtcacgcaggtctagggattcgccggtgtagttccgtccgctgcgccggcgggcgatcacttgctcgaggggtgcgcgcaccctgctggacctgggaagttcgatcacatcggcagcgaacgtgtcgcgatccatctgtccgtacgtaacgatcatggggtcaacgaaatagtcgccgaccgagacgttgaactccatatccccccgggcgatgcgcgaggcgagcaagaagtctgcagctgcgttagacagccccggcccatcagtgttgtcgcagcggaactcgtgggtccgaaaccccacaccttccgtgcccgggctctgcgctcgatacgacgtgatcgcagaactagccttccttaaaccgcccggagtagctaccatgaccgtcccctctgaggtctcccgaacacttgcgacaatagcagcatgtgggggcagccgccagaggcgggcatccttgtctcgacaaccattgacctccggattcgatatgtgcataatcatagtcgtgccaacacgaaacgtgtacgtctcggaagacgacctagacctgttcgccgaagccaccgagatcgctggaggcctgtccgcagcggtgttggaggccttgcgcagctacgtagacaggcaccatcgcgcggccggcggattcgacgagatcgagctggagctgcagaacgacggtatcgaccaccgtgtcaccttcatgggtcgccgcctgatacacatccgccgtccagatcccgagggaacccgcatagacactgtctacttgaccgccaaacaccaattcgccgttgccaccaaaatccaacgacggctgccagactggacggccggccacgagcacatctggtccgacccggagacctggaatcgggagttctggatcgcaggtgacaagacgatggccgtgtatcccagccttgacaaactccgcgaagctgaccccaatgtggccgaacgcgccgaggccgcggtcaaaatcccgccgttcgaggtcctggacatctgatgacagaatcatcatcttcccggcggcaattggcaatgccggtgctgtcagtcacggatctagccaagaaatacgtggttcatggcggctacgaggtcccggcactcaacggtgtctcgtttgacctgcacccgggagagatgctgggtttgttcgggccaaacggtgctggaaagacgacgctggtcaggatcatcgcgggcctcttatcggcagattctggagacgtccactggggatcggatcaaggtcgggccaggttaggctacgtgtcccaaaagggtggactgcagtacgggctcacgtgccgggaagagatggtcttccacgcacaatgcttcggccagtccgccaagcaggcccggactagcgtcgacgaggtcgccgcgatgctgcactgcgattacctgatggagtgggacgtcggaaggctctccggtgggcaacgccgaatcatcgaggtagggctagcactcgtcaatcaaccatcggtcgtcctgctcgacgagcccaccctgggcctggaccccgcaacacgcctgtcgttgtggcaaacggtaaagtcggcacgccgtgagaccggtgctgccttcctcgtcaccacccactacattgacgaggtggccgagcacctgtccaacgtcagcgtgatcaaccacggaaccgtcgtcgccaacggctcgccagcgcacatccgagaaatgttcgcgaccggggaagtaacgctcggcgtggccgaggatacggtggacagtgcggtggacgtgttggctgggaccgcgttcgaggcgcaccccaccgaaaccgtcccggggatcgtggtcaggtccaggcatcccgacgtggacgcggccaagatcatcaccatcctggctggtcatggcatctcggtggactccatatccgtacgcgaggcgaccttggaagaggcgtttctcacgatcacaggcagtcgagacccggagaggcaaatcccatgaacacttgcttcaggcgatatgcggcgatgtcgctgagagcgcggcgtgatttggccctgacattcatccagcccctcgtctacctagccctcttcggaccgctcttcgtcacgacgatgaagatgtcgcagagagctaccgccgctacgggttactccctatacatcacgggcctgtccatccaaatggccatgacgatcggtgccttcgcggggctaaccatcatcctcgaataccgactcggcatcctcgaacggatctggagcacccccctcacggggagcaagatgatggcggggcgaatcgcgcgcgacgtcgttatgatgatgatgccgatactggtcgtcttcatcatcggcctggtgctgggaacacgccccagcccactgggcctggcgacctacttcgtgacagtgctcggcacaggagccacgttcgccggggtctcctacgcggtggcactcagaacgaagagcgaggcagcgctatccgcgatcttcaacctcatcctgctacccatcctcctgctgtcggggatcatgctgcccatgtcgttcgcaccacactggatcgccaccgctgcccacgtgaacccgttgtggtacctggtgcaaggcgcgcggaaccagttcagcgttctagggctcgtggcggcggccccatggagttgggctgtggccatcgtcatgtcagccgctgccttcggctgggcaagccacgaattcaacaagaggcgctgacacaaagaatggtgccgggaacccaggtccccggcaccaccgagtgcactcgcgacgtcaacgcaccgttgcggtcactgcgcaggtcgagcacgaggacgacgagcccgcgctgctgcaggtcgagccgccaggcgcgagcaggtcgacgttagcgtcggcgccgccgaagacggacgtgacggccggctgagaggtgcggatgcggtgctccagcgaggaggtggtggtgagtttcatgggaggtgctcctaggagtgagacgagaacaaaccctagcgataggttagcagtccgcaaccgactccgggaatagtagaagcgcgcatccgtagcggaagaccttagcctgattacagtgaccctgttcgcgtctcaacattattccacacccccgagcagcgaacgacaccgcgatgatgatccgtcgcctctccaccgaagaactccgcgcccacatcgcaccgggccgccgtcccgtgcatcagacctgccgtcaacgtcggccatgaagctgggaaggtggctctcgtctaggagcagacgcgggacgcctcctccaggttgggccggggaagtgtccggttcttgatgtaggtggcggtccctattgatgggcgttgaccgtgggaatgcggtcggcgaagggggtggcgaacccgttgagcgcaggcttccagcgcatgcatcaacgctgtctgccggccaccggcaagcctcacccgcccgtcatggccatcatcgaggtgccggtgaatcctcgacacatgatcccaactcccccggaggggcttccggggctgttcagccaccagatcagccaggcggcgagcccgactctgccacccggaccctgcagagcgtgcctgctgccgtcgtgtcgtgtcgggccagtgggccaccagatcggccacatccgtcttggcccat

SEQ ID NO: 116 - DNA, 12654 bp, Propionibacterium acnes
gtgagtttcttccattgatgacaacagcacggtgctgccgtctgtgtgcggccccccaccccgcacacagttgccgtcgaggacgttgttcatgctctgtggtggccggtcctgagggcggctcgcaggatctcccggcgctcacggcgacgagcctggtagccaaggtctgcatgttcggcggcgagacgggctttgagggttgcggcttctgcacggcggtggagttggtcgtcgatgagttgggcgcgggccagacgccgcttatgggggttgtcgtgggtgaggggggcgtcgaggctgccgtcgtgggttagggccagggctgctcgttcggcgtcgtcgaggccgatgtggtggacggtcacgggtgcggtggtgacgtcgaggatgtccaggtggatgttgtggccgccgccgggggcttcggggaagtctggtgggctggcctggccggtgtcggggtcataccaggacaggccgatgatctcggcccagggtgggggcgggcagacggctcgcagaagggtgtgggccaggaacgtgttgcgggccatgatgcctccaagggtgaaaagcagtcgagtagcgatgacggcggggtagccgtctgctgggctgaggccgaccgggcccatgtcctcgatgctcttgtgctgcggccataccccaaagctaccaaacagtctttttaatctcaaagatacaaacagtgcttgacatattatctgcagcgaaagatactttcatcatggtggctgatcatgattacgcgactcctgacgatgagtggatgacacctcctcaggtggcccgtgtgattccgaacaccactgctcaggctgtccggcgctgggctgaggagggtcagcttcctggggcgtttcgtactccttctgggcgttggcatattccgtggtcggctgtggtgggcatcatggggtttgatccgcgtgagtccgcatcaccgagtgatcgtcaccagagctgacagagtcgtcgatgagctttcgagtgcagagctgatggcacgacggtctggatacttgtggagatgagagacgaccacatccagtcatggtcggggtacaccgaggggcagattcagcagtgctggcacgatgaggttgcccctgccattgactcgctcatggagcaggtaaggtctgttgccgagactcctgtgccgccgggttcgagattttacggcgatgagcagtgggccaagccttttcatccgtctactgcgatctgcggttcaatgggtccgccagcgatcacttgcacgcgctgaagctcctcgtctgggaagcgaacgtccaccatgtctatgcgccgtacacccttgctcgtgcatctattgaggcatcgtctactgctgtgtggctgttgagcacgaagacgcgcggagaacgtgtgctgcgagccttgcgatggtacgcgcaggattgtcacgactcgtgcaggttcatggatgatgagcagtatcgtgaccacctattgcggcgcattgaggggactgtcgctgcgggaaatctcgactcgcgcgctgctaggaaacggtaccgtgcaaccgatgttgtcgatgaggctgatcagctggttcccggaactctgagggcgtggcgagctttttctggtatggcccattcccgtatgtgggcatccagggggctgctcgacatggaagtgctgtccagtggccaaggaatggttacggcgaaggtgacgagcggatcggcccaaatcctttgggccgtcgtggcagctctgaatgttgctctcagtgccgctcgcttgtggcgtgattcgatgtgctcaccgtttgctgttgcccagtcggtagacgcgatgccagaggcgtttcgccgccctgtttagggtctgatcggggtagtgggtgttcacggggtcccaggttggccatggggcggcttggtgatgtgagttgggttgtgtggcagcctgggtgttgggtgtggcttcgttggccacgaaggcatgctcttccttgtgctgggacttgagtccccagtgctctcccctttgctagtggggggtggggtccccggaggtaggtcctccggggactttttctatgtctgtccgtgccccaggatttcgtatctaggcagtaccaattttgggttagttggaggtttctttggtaatggacagggtgagggtgatgaagaggtggccgtccttggtggcagaaattttctcgaacttcagctgaatgttgttatcagccactatctgttgggcggtgaggtgctcggagagcttctggaatccttcgcggatccacaggttgtaggggttggtgaccgagaccgaagggtatgggtcgaccttcagcgtcaggactggctggtctgggttgagggagttgatcttcaccagtttggggtaccggtcgcactcatgtgtctcttgtgttgggggccagcagtcgggggcccattcctcccagtggtcacgcatctcacgaagtactttcctgcatctcagcctctgcaggagctcgcgcgccaccgatgggagggctgccatgatgagggcaaggactgcgaacccgatgatgtaattgaccgtgtccctcgtcacgccgttcttgccgaggattccgatggcgaacgcgatgacgacaccgcccaggcacaggtgcatggggtcatgctgtgatggtttttcttcttcagcgactggtggggctatagtcatgtgtgccccttagtactaagtgatactggtgggttgcttttccccggtggccgtgtgcaagacggccaccggggttttccttcatgttcctgattttatctgcccggtgtggcgttttcatctttgtgtgggtggttcgcctggggtcttggagtgtggtgacgcggtgatggtcacggtgacggtgactgtggcgcgtggcgggtgaggtggttctttcctggtctggtgtgtggcccaggtgagtgtggtgatgagggccagggtgaggatgatgaccagggtggggagtagtttgtctggccggtgtcgccgggcttggtggcgcggcatgtttttccagggtgtgtctccgaacaggtcgtcgtcggaggggtcgtcgtggttcatagggtggccttggcgatggtggtgggcgagtttggtccaggtgatggtgccgtcggaggcgatgtggcggtcggcgggcagggtgtggacggtccatccggcgtcggtgagggcggtggtgaaggatttcttgatggatcgtttgggtaggtcgatgggggcgtgggtgccgacccagatgcaccggtttttgaggtgggtggcgccgaggtggttcatgtcgcggaccatgttttgggtgagtgtgagggtgtcggggtcccattggacggggatgatgatgtggtctgcgatggtgatggcgtgttgccaggcggcgtcgaggtcgttgtttccggtgtcgaggatgatgacgtggaagcggcttcttagggcggtgatgatgcggtcgaggtcgtcggcggtggggggtgtgatgaggctgttgtggttgtcggtgatggtgggtaggcatgtgatggtggcccagccttctggttgccaggagatgtaggggtcgaggtcgcggggttgggaggcgaatcctgggtgacgggctgcgcgggcgaggtcgatgacggtgttgtcggtgtggcggggtgcgcgggtggagagggtgccgcgtgggttgatttccacgacgacgatgtcgtcgtgtcctgctgtggtggcgagggcttgggcaaggatgacggccagcggggttttgccggtgccgcctttgaggttggcgagggtgatgatgtggtcggtgagttgggcgggtgcggcggtgtggtgagggttggcggtgaggttggcgatggtgaacagggcatcgagatcgtcggtggtgttctgctcggtgggttgggggtcgccggagatgatcgggtcggcgcggcgcggctgccatgccggcctcaccactgtcacgaccaccacgggtctgctggcgctgtgtgggtgtcgtcggcgatgactcacgatcggcagtctcaccatcgtctcggtgatgctcggctagcgctggacccggtcaagttcgggccggctcacccagtggtgatgactcggtcacagaaccgctgccggtcgttatctcggacgtctcgactcctccagtcctgatgggcgttggagccacctacacctactctcagaacgaccccgacctcgtgtggggcgggggcagatgtcacttgggccaatcgagagcccaggtgatggggaaagcaggggtgtgatatctgtcctggaaaactgggcagctgctaccgtggattgacggatctccacgaaagaagggaatgcgaccatgcagatcaccgtcaagaccatcaaagatcatcgggttcgcactgtccagaccgccatgagcagcgccttggggattggttcccaggtagacatgctcgcccccggcggttccaccagctcgagttccggttcatgctgctcgtgctcgacctgcgcggtagtggcgcagcctcaagactgaacggctggtcagccccaggggcgtggcgctcatcgcgtcacgccccttctattcgctggacagggtgcgcgagctgaggaacatcgcggtgtgtgcgatgacgaggggcaggagcaagtctgtgcgggttgccaagtagccctgcgcgatggccatcacgctggccccgacggcggcgaagacacctccgatacgtcgcttcatgccgccgaattgcatcaggacgaataggactcccgcggtccacatccctccgggcatgcatctgggaaagatgaaccggaagatgatctcttcacaggagagctggagtactagcagcgtagcccccacggggagactcacctctactgacagacggatcgtcttcatccacccacccgagctggcatcgaccatttcggtggccatgcgcgaccggtggcctcgtgcctctcgctgcgtgtcgatccagccgagcagtccgtggacgctctccgctaggactcctgacgcgacagtctcaccaattcctaagcccacggcgaggaccgcgacgcccccctgcacggcaggctgtgtgacttggtggtcccaccaacccgccggcaggaccatgcgtgcgaggctgcacacgagcaggaggtggagggtcacgacgagcgacatctggaataccgcttgccgttcggcgatggtggcgttgggaaagagcggtaggccggcacgggcagcggcgctcgacagcttccgcaagagcggtttggagacgaagtagtaggcgacgtacagcgccagcgctgtcgcgatgatgatcatcggtctgccaccgagctgacccgccgatagccgtttctgttccaccaatactggctgttgtagatcaggtggcccagaacacaggcccagatcccccagaagatgaacaggatagtccccaaggcggcgagcgggatcttggagaggacctgtccccgtccgaacaccgagtggccgcaagcaaacaagagtgctcccacagcggtgagcgcgagccaggccggggttgctcgcagactgatcaccgggaccccgacccggaagccgacctcttctcctacagcgatgactagcaactgccacagcggcatgttctgaacggagcgcgcgactcgggctcgagtcacccacacgggctgttgagcgctcacatcaccactcaggtaccccggtgaggcacttcgcttagtactggggcccgatgtgcgagcattcgtgatgtgtcgcaggatccggttgtcaagccaagaggccagcagggctccggcgacagtgacgggtagcccgatcagcacgaggccccagccatgcggtgccgagaggtttctggccggcgtgcacgcgaggcaggcaagtgccaacactgccagcactacgacgtagatggtcgcataattcgacttgcgggtgacgttgccgaccatcttggccaaagtcgctggggaccagctgatgagtgcgatggtggtcagcaggaagcaggaccagacagacatccggcgcactcaggggtatgggtgcggctgtgggttttggaaaccgccatatgcggcgtagcgggggtgtgcccgcatgggtgcgctgggcagtgacagggcgagcagcccaggcgcccagagcctgacacagtgcagtcccagcccctggatctctatggtggtgaaatcttcgatgtacaggggtgacacacaggtgatgctgttgaccacgctctttaccagttccgcccccgtgtgggtgtcgtcaggtggcaggtcttcggcttgggcaatggtgcccgcgtcgaatttcgccacaactgattgcgcggcctgatagttcctcgcgtagtaggagacgttcgagtcgaggtcaagcatgtcctccgtggacatactggacgcgtcggcctcggcgtcgaaagacgtccataccgcgagcatccgaaccccgctgcactcgagaaacgccttgtacatggctgcttccagacccgcgtctgcacctaggccgacggcgacgaggggaagttggttgccactaccgaccatcatgcatgccacggtgaaatgcttgagcccgggagtcggaagccagtagaaacgcagttcgtggcttcggcccgctgcacgttccacgagccgctggatgcgctggaggcggggtccttcgacgcggatgcgcacaggtgacgaggctccataccacaggcccatcgcggcatctacctggatcaattcataagccgcggacagcgttgcggcgacgcgtgaagtgtggacggcggtgccggtcgtcacggccgttcccagccacggctcaccgtcgtgccgacgggggttgtaacccaggtaaaagaactgcgccgggatccactcctgccgggaggtcccgacacggggagtcttgacccatgtcatgggcaagtcgtcgcgataggtgtcgaacgcacctccagccactcgttgcgcgaagccgaatgcgcccagatcgagaacttcgtcctcggtccgggcgaggagttcctgacgagtcgcccagcgccgttcgaagggactatggagaatcccggtacccgcgcagtagcgctcgacggcctccgcgtagaccttgatctctgcctcaaactcgttcagccccaccccaccgatgtggtagctacccggcttggggtcgggccggtcaagcagtgcgtgcatccccgtgagttccccaccgttcacccgcacgcgggggccgagcgcggggtgcagcgagtagccgacggaagtcaccagcccgcatagcgggctgtaggtgcgccgcctgagccgggctgcggtctcgacggggtcgctatcctggcgaagcttcatcgctcgccccctgccgccagccactcacggatgtcgtagtacaggtccggagcggtttcaacctgcgctggtgcatcaaaacgggacataggtaggacgtcgttgtaggcgatctccatcgtcggtatgtagaccgacaacactttgttgcgcgtcgtgttgaggccgttgcgggcgatgctgacagcctcatgcgcgacgtgcgcggccaagatcgcgcgcaccgacgctgccacggccggcgctccggcccttacgcggtcggcagcggccacccgcatccaggacaggtagctctgccgttcgcgcaggttcatcgcgacccgctgctcgaaggtccggtaggacgaggtcgcaccagggacgacgtagggacccacgtacaaggccggcccgtctacagctgcgtggagccacgacaggtgggcgcgtcgggcgaacaggtcaagggcgcgcagcatagccgggttgttctgcgccagcgctaccacaaggagtggctgcaggtccggcgccgaacccagcaacgccaacatctgggaggcctcctgctccatgtgcaactcgtcggccgactgctcaagccgcaggcctgcgaagagggtggctgatggctgcgtgtcgtcagcgaggacggtagcctgcagcccctctccctcgagaatctgctggatatcgccggcgaggagcgcgtcgtcgctgaatacccacaccgggcgcgtctctctacctccatccatcttgtcctcaacgttttcgaccagcgcaccgatcgatgctaggtgggccatcacgtcgtcaagggccgcgcgggtcaatccgggcacccgggacacgatctcgggcggctgcagtccttggctcaacaagtccaaggccggccacagggtcccggtggcgtcgtcgtcctccagcgttgtgctctcggcgttccagacgcctcgacggaactccaccctgtccatcgagtaaggcaccatcatgaggcccggtgaaatgtggttggtcactttggctcctgtacagcctaggcttggacgcccacggtcatggtgtgggtcgcggtttggaaaatcccgtcgaggttgagtgcctgattgagttcgtcctcgtagaagcttgaggactcgactgaggcaagaccgagccccgtgcagaccaagttgatctgttgtgcgatcgccccgacttcttgaagggcgaacctcaaacccctggctccgtacttccgcatcgccctccacggcgagatgacgaacaccaagtgcactccggccgcatccgattgctccacggccggctcgccggccatcgaattcctcacgccgcgacagccctcttcaccggtcacgggcaccagtcgatcgatgaccggcgagtagcggtagacgccgcgactcaagccggacacccgttgtgcggacatgaagatagacacgggatacagccctccaccagacgggacagcgcgtacattataccgcacgatatcaccgctcgaacgtgggacatccacgtgccccgtcacaccggcagcacctctcagaaacgcagctacgtcacgcaggtctagggattcgccggtgtagttccgtccgctgcgccggcgggcgatcacttgctcgaggggtgcgcgcaccctgctggacctgggaagttcgatcacatcggcagcgaacgtgtcgcgatccatctgtccgtacgtaacgatcatggggtcaacgaaatagtcgccgaccgagacgttgaactccatatccccccgggcgatgcgcgaggcgagcaagaagtctgcagctgcgttagacagccccggcccatcagtgttgtcgcagcggaactcgtgggtccgaaaccccacaccttccgtgcccgggctctgcgctcgatacgacgtgatcgcagaactagccttccttaaaccgcccggagtagctaccatgaccgtcccctctgaggtctcccgaacacttgcgacaatagcagcatgtgggggcagccgccagaggcgggcatccttgtcccgacaaccattgacctccggattcgatatgtgcataatcatagtcgtgccaacacgaaacgtgtacgtctcggaagacgacctagacctgttcgccgaagccaccgagatcgctggaggcctgtccgcagcggtgttggaggccttgcgcagctacgtagacaggcaccatcgcgcggccggcggattcgacgagatcgagctggagctgcagaacgacggtatcgaccaccgtgtcaccttcatgggtcgccgcctgatacacatccgccgtccagatcccgagggaacccgcatagacactgtctacttgaccgccaaacaccaattcgccgttgccaccaaaatccaacgacggctgccagactggacgaccggccacgagcacatctggtccgacccggagacctggaatcgggagttctggatcgcaggtgacaagacgatggccgtgtatcccagccttgacaaactccgcgaagctgaccccaatgtggccgaacgcgccgaggccgcggtcaaaatcccgccgttcgaggtcctggacatctgatgacagaatcatcatcttcccggcggcaattggcaatgccggtgctgtcagtcacggatctagccaagaaatacgtggttcatggcggctacgaggtcccggcactcaacggtgtctcgtttgacctgcacccgggagagatgctgggtttgttcgggccaaacggtgctggaaagacgacgctggtcaggatcatcgcgggcctcttatcggcagattctggagacgtccactggggatcggatcaaggtcgggccaggttaggctacgtgtcccaaaagggtggactgcagtacgggctcacgtgccgggaagagatggtcttccacgcacaatgcttcggccagtccgccaagcaggcccggactagcgtcgacgaggtcgccgcgatgctgcactgcgattacctgatggagtgggacgtcggaaggctctccggtgggcaacgccgaatcatcgaggtagggctagcactcgtcaatcaaccatcggtcgtcctgctcgacgagcccaccctgggcctggaccccgcaacacgcctgtcgttgtggcaaacggtaaagtcggcacgccgtgagaccggtgctgccttcctcgtcaccacccactacattgacgaggtggccgagcacctgtccaacgtcagcgtgatcaaccacggaaccgtcgtcgccaacggctcgccagcgcacatccgagaaatgttcgcgaccggggaagtaacgctcggcgtggccgaggatacggtggacagtgcggtggacgtgttggctgggaccgcgttcgaggcgcaccccaccgaaaccgtcccggggatcgtggtcaggtccaggcatcccgacgtggacgcggccaagatcatcaccatcctggctggtcatggcatctcggtggactccatatccgtacgcgaggcgaccttggaagaggcgtttctcacgatcacaggcagtcgagacccggagaggcaaatcccatgaacacttgcttcaggcgatatgcggcgatgtcgctgagagcgcggcgtgatttggccctgacattcatccagcccctcgtctacctagccctcttcggaccgctcttcgtcacgacgatgaagatgtcgcagagagctaccgccgctacgggttactccctatacatcacgggcctgtccatccaaatggccatgacgatcggtgccttcgcggggctaaccatcatcctcgaataccgactcggcatcctcgaacggatctggagcacccccctcacggggagcaagatgatggcggggcgaatcgcgcgcgacgtcgttatgatgatgatgccgatactggtcgtcttcatcatcggcctggtgctgggaacacgccccagcccactgggcctggcgacctacttcgtgacagtgctcggcacaggagccacgttcgccggggtctcctacgcggtggcactcagaacgaagagcgaggcagcgctatccgcgatcttcaacctcatcctgctacccatcctcctgctgtcggggatcatgctgcccatgtcgttcgcaccacactggatcgccaccgctgcccacgtgaacccgttgtggtacctggtgcaaggcgcgcggaaccagttcagcgttctagggctcgtggcggcggccccatggagttgggctgtggccatcgtcatgtcagccgctgccttcggctgggcaagccacgaattcaacaagaggcgctgacacaaagaatggtgccgggaacccaggtccccggcaccaccgagtgcactcgcgacgtcaacgcaccgttgcggtcactgcgcaggtcgagcacgaggacgacgagcccgcgctgctgcaggtcgagccgccaggcgcgagcaggtcgacgttagcgtcggcgccgccgaagacggacgtgacggccggctgagaggtgcggatgcggtgctccagcgaggaggtggtggtgagtttcatgggaggtgctcctaggagtgagacgagaacaaaccctagcgataggttagcagtccgcaaccgactccgggaatagtagaagcgcgcatccgtagcggaagaccttagcctgattacagtgaccctgttcgcgtctcaacattattccacacccccgagcagcgaacgacaccgcgatgatgatccgtcgcctctccaccgaagaactccgcgcccacatcgcaccgggccgccgtcccgtgcatcagacctgccgtcaacgtcggccatgaagctgggaaggtggctctcgtctaggagcagacgcgggacgcctcctccaggttgggccggggaagtgtccggttcttgatgtaggtggcggtccctattgatgggcgttgaccgtgggaatgcggtcggcgaagggggtggcgaacccgttgagcgcaggcttccagcgcatgcatcaacgctgtctgccggccaccggcaagcctcacccgcccgtcatggccatcatcgaggtgccggtgaatcctcgacacatgatcccaactcccccggaggggcttccggggctgttcagccaccagatcagccaggcggcgagcccgactctgccacccggaccctgcagagcgtgcctgctgccgtcgtgtcgtgtcgggccagtgggccaccagatcggccacatccgtcttggcccat

SEQ ID NO: 117 - DNA, 12567 bp, Propionibacterium acnes
gtgttccagtgcctcgcgggcgtgatgttcttcttcggcaccttcttgccacatgcttcgcgcttcagcctcgccatccaagcgaacctggactgtgaacgagtcctcatcgggtccgtcctcattccacgcggcaatgatcccacgggcctcgtctgcgacctgactcaacttcatcgcctgcccgacagccccgagagccggaatctcgaacacccagatattcgcctcagccgagacctcacgatgggcgatcacttcgtaggtcgtctcaccttctactgtcgtgtccattacttccactccttcggaattttcacgcctgctcgctccagctgtgccaggacaccaactgacgtcagctggtgtcctgctggtatcgatacgcgcccggctccgccggggcgtccccagatttcatggcttcccttggcgttccgcagacgggcccatccttgagaacggagcagcttgaggacgtccttagttttctgcggtttcacacatcatagtatagccccacttaacttgtaaactaagcccctgtttacattttagttggtgcatgtgatccctgctcttatgacgtcgcccgacctggcgccttagacatgcactgttcatcctcaaccacactcaccgtcacgggtccgaaggcgaggtctatcaccattcgcatcgatgaagttgaagcaggatcgtccgcatcacgcactgccgatccggacagacgccaccggccgtaccgactgtttacgatctgccaccgcagactgctgccataaccgctatcacctctgatagtacgtttagtactatcagaggtgattcaagattctcctgtcgagcagccctacagtcacgaagtcctgcgatcgtcatcgcttaaggcagacggatggccatcggggaccactcgcaaagcaggggcgatcagcaacagtgatgtgccatgagcaagtactggtgcaccggctgtttactccgcccctagataaaccacgggtgcaggggtggacaccacaccatgaccgatgtggtgcccaccccatggctcacaggcaggccctatcgccgggagcactgctgcagatgaggctcagtaacctgccatgtctcacctggggccaaggtgccaagctccccacggaatctcaggcatcggaaaccagcagccgaacttccacagcatgagcgccctacgaaaaagcaggccgccgacggttctcaagaactcgccggcggcctgcatcgccactcgaactgtaaccgtggtccgaccccgtgcacaggtaagctccacactcccaccaggcatggccgaggcagtaccaagttgccgtggcccatcggcagatttggttaaattttgaaaagtcatatagactccttctgtaaatttttaaatctcataggactctcgccatcgccagccagcttcgacaggagtcccgatgtttcaccgagtgaaatatcggcaccgtttgagttgacctaaagctcaaaagatgctagaatccatcttacctcgttaggggcgttttgtcaaacgcccctatattgcgtgtcttcgcgcgtcgtagcgctgatgctgcgcctgtgtcgactatccgtttgtaagtactttcgatgacaccagcagtggctactcatgactggtgcgtgcgggtctaaagcagcagggaaaggaatcgcagtagaagccgcttgattcctatcacccctgatggtactatcagtactaacagagcagggcttactcgatgcgtgagaatcggggacatgctgagcctctcgtaggtcattggcctgctgggcgtcagtgtggcgcggttcgatccagtgaactctatcagctctgttagtactgtcagagttgatatattcgaccccaggaggagcccatgagttacatcgttcgcaccggaaatttggtcgacacccccgagctgcgtgagggagagcatggcccgtacacctacgctcgcgtcatcgtgtccgatcgcattcgccaggaggacggcagctacgtcaacgggccagcgatcgcctacgacgtcttggcgggtggcagccaagccgtgaatctggttgaagccgccaaggcgagcggcaacatccgcatcatgttcgcgggccgttaccgcgtcaccgagtggcggggtgagcagggcactcgtatccagcatgaggtccgagccgacgaagtgagcgtgagcctgctcggtcagagggtgaccgtggagcggcctcgaggtgacgtggcatccaaggagagcacgtcgttctgattgagtccgggggcacggtggtcgccgtggtaaaccgtgcccctgacagtactattgacactattggaggtatcagtgtgactgctcaaattttcgccttgtgcaaccagaagggtggcgtcggaaagtcgacatcgacgtttcatctggcccgtgccgcggtgttgcgtggccagcgtgtgcttgtcgtcgacaacgacccccagggcaacctgacgtctgtcgcggccgccgagcccgtgggggaggatcaggcggggctggccgatgtgctcagcgcgcgtgctccagagaccctccgcgatgtgatcgtgccgggaatctggtctggcctcgatgtcgtgccgacgtctggcatcacgctcggctgggtgcgtgacgaactcgtgatcgccggtgccggccgagaaggccggctgcgggaggccctggccggcgtcgaggacgactacgacgtgatcctgatcgactgtgctccatcgctcgatcagctcacgatcaacggcctggtggccgcccagggtgtcatcgtcgtgacgcactcgaagttgtggagcgccaacggcctcgcccagctgctcgacaccatcgacagcgtgcgcagctactacaacggcgcgctgcgcgtggcgggcatcatcgtcaaccagcacgaggagaacaccatcagcgggaaaacctggctcgacgagctgcatcaggctgccgagtcccggaagctgaccgtgcttgacccgccgatccccaagcgtgtcgtcatcgccgataccgtcgaggccgcgcgcggtctcgacgagtggggaagtgccgaggcggccgcgctcggccagttgtacgcccaccacctgacctgcatcgaaggagccctgtgatgacccgtccagccccccgaaagtcctcattgagcggatcaactccggtcgccccgccggctcagacggcgccggcaccgtctgccgcacctaccccccacaaggccgatgagtcacagacgagcagcaccacgaggaagtggcggcacaaggtgtcgttctaccaggacccggccgacaccgaccgggtgcgcggggcgatcctttacacgatgacgaccgagggcaaccggaacctgagccagttcgtcaacgatgccgtcatggccaaggtggtcgagctggaagtcaagtacaacgatggccagccattccccgctgtgggagcccgaggactaccccagggcggtgcagccgccgccggtgagtagaggaccatcgaccgtcgggggcttcaccatgcccccgaccctcggtcatcctgatcctcttgtcgatggtggtgacagtgggggattcacgcctcgttcagatcagaggaagtctcaccgcgtgattagtactatcaaatctgacagtactaacagagcagatagggttccctaggtcgagctgtatcacgccgacaaccagtgagccagtgatctacgaggggcgcaatatgcacccgatcggtagccgcgaaggcctcgccctgccccgatagtactatcaccactatcaatggtgctagtggtgagtttcttccattgatgacaacagcacagtgctgccgtctgtgtgcgggccaccagcccgcacacagttgccgtcgaggacgttgttcatgctctgtggtggccggtcctgagggcggctcgcaggatctcccggcgctcacggcgacgagcctggtagccaaggtctgcatgttcggcggcgagacgggctttgagggttgcggcttctgcacggcggtggagttggtcgtcgatgagttgggcgcgggccagacgccgcttatgggggttgtcgtgggtgaggggggcgtcgaggctgccgtcgtgggttagggccagggctgctcgttcggcgtcgtcgaggccgatgtggtggacggtcacgggtgcggtggtgacgtcgaggatgtccaggtggatgttgtggccgccgccgggggcttcggggaagtctggtgggctggcctggccggtgtcggggtcataccaggacaggccgatgatctcggcccagggtgggggcgggcagacggctcgcagaagggtgtgggccaggaacgtgttgcgggccatgatgcctccaagggtgaaaagcagtcgagtagcgatgacggcggggtagccgtctgctgggctgaggccgaccgggcccatgtcctcgatgctcttgtgctgcggccataccccaaagctaccaaacagtctttttaatctcaaagatacaaacagtgcttgacatattatctgcagcgaaagatactttcatcatggtggctgatcatgattacgcgactcctgacgatgagtggatgacacctcctcaggtggcccgtgtgattccgaacaccactgctcaggctgtccggcgctgggctgaggagggtcagcttcctggggcgtttcgtactccttctgggcgttggcatattccgtggtcggctgtggtgggcatcatggggtttgatccgcgtgagtccgcatcaccgagtgatcgtcaccagagctgacagagtcgtcgatgagctttcgagtgcagagctgatggcacgacggtctggatacttgtggagatgagagacgaccacatccagtcatggtcggggtacaccgaggggcagattcagcagtgctggcacgatgaggttgcccctgccattgactcgctcatggagcaggtaaggtctgttgccgagactcctgtgccgccgggttcgagattttacggcgatgagcagtgggccaagccttttcatccgtctactgcgatctgcggttcaatgggtccgccagcgatcacttgcacgcgctgaagctcctcgtctgggaagcgaacgtccaccatgtctatgcgccgtacacccttgctcgtgcatctattgaggcatcgtctactgctgtgtggctgttgagcacgaagacgcgcggagaacgtgtgctgcgagccttgcgatggtacgcgcaggattgtcacgactcgtgcaggttcatggatgatgagcagtatcgtgaccacctattgcggcgcattgaggggactgtcgctgcgggaaatctcgactcgcgcgctgctaggaaacggtaccgtgcaaccgatgttgtcgatgaggctgatcagctggttcccggaactctgagggcgtggcgagctttttctggtatggcccattcccgtatgtgggcatccagggggctgctcgacatggaagtgctgtccagtggccaaggaatggttacggcgaaggtgacgagcggatcggcccaaatcctttgggccgtcgtggcagctctgaatgttgctctcagtgccgctcgcttgtggcgtgattcgatgtgctcaccgtttgctgttgcccagtcggtagacgcgatgccagaggcgtttcgccgccctgtttagggtctgatcggggtagtgggtgttcacggggtcccaggttggccatggggcggcttggtgatgtgagttgggttgtgtggcagcctgggtgttgggtgtggcttcgttggccacgaaggcatgctcttccttgtgctgggacttgagtccccagtgctctcccctttgctagtggggggtggggtccccggaggtaggtcctccggggactttttctatgtctgtccgtgccccaggatttcgtatctaggcagtaccaattttgggttagttggaggtttctttggtaatggacagggtgagggtgatgaagaggtggccgtccttggtggcagaaattttctcgaacttcagctgaatgttgttatcagccactatctgttgggcggtgaggtgctcggagagcttctggaatccttcgcggatccacaggttgtaggggttggtgaccgagaccgaagggtatgggtcgaccttcagcgtcaggactggctggtctgggttgagggagttgatcttcaccagtttggggtaccggtcgcactcatgtgtctcttgtgttgggggccagcagtcgggggcccattcctcccagtggtcacgcatctcacgaagtactttcctgcatctcagcctctgcaggagctcgcgcgccaccgatgggagggctgccatgatgagggcaaggactgcgaacccgatgatgtaattgaccgtgtccctcgtcacgccgttcttgccgaggattccgatggcgaacgcgatgacgacaccgcccaggcacaggtgcatggggtcatgctgtgatggtttttcttcttcagcgactggtggggctatagtcatgtgtgccccttagtactaagtgatactggtgggttgcttttccccggtggccgtgtgcaagacggccaccggggttttccttcatgttcctgattttatctgcccggtgtggcgttttcatctttgtgtgggtggttcgcctggggtcttggagtgtggtgacgcggtgatggtcacggtgacggtgactgtggcgcgtggcgggtgaggtggttctttcctggtctggtgtgtggcccaggtgagtgtggtgatgagggccagggtgaggatgatgaccagggtggggagtagtttgtctggccggtgtcgccgggcttggtggcgcggcatgtttttccagggtgtgtctccgaacaggtcgtcgtcggaggggtcgtcgtggttcatagggtggccttggcgatggtggtgggcgagtttggtccaggtgatggtgccgtcggaggcgatgtggcggtcggcgggcagggtgtggacggtccatccggcgtcggtgagggcggtggtgaaggatttcttgatggatcgtttgggtaggtcgatgggggcgtgggtgccgacccagatgcaccggtttttgaggtgggtggcgccgaggtggttcatgtcgcggaccatgttttgggtgagtgtgagggtgtcggggtcccattggacggggatgatgatgtggtctgcgatggtgatggcgtgttgccaggcggcgtcgaggtcgttgtttccggtgtcgaggatgatgacgtggaagcggcttcttagggcggtgatgatgcggtcgaggtcgtcggcggtggggggtgtgatgaggctgttgtggttgtcggtgatggtgggtaggcatgtgatggtggcccagccttctggttgccaggagatgtaggggccgaggtcgcggggttgggaggcgaatcctgggtgacgggctgcgcgggcgaggtcgatgacggtgttgtcggtgtggcggggtgcgcgggtggagagggtgccgcgtgggttgatttccacgacgacgatgtcgtcgtgtcctgctgtggtggcgagggcttgggcaaggatgacggccagcggggttttgccggtgccgcctttgaggttggcgagggtgatgatgtggtcggtgagttgggcgggtgcggcggtgtggtgagggttggcggtgaggttggcgatggtgaacagggcatcgagatcgtcggtggtgttctgctcggtgggttgggggtcgccggagatgatcgggtcggcgcggcgcggctgccatgccggcctcaccactgtcacgaccaccacgggtctgctggcgctgtgtgggtgtcgtcggcgatgactcacgatcggcagtctcaccatcgtctcggtgatgctcggctagcgctggacccggtcaagttcgggccggctcacccagtggtgatgactcggtcacagaaccgctgccggtcgttatctcggacgtctcgactcctccagtcctgatgggcgttggagccacctacacctactctcagaacgaccccgacctcgtgtggggcgggggcagatgtcacttgggccaatcgagagcccaggtgatggggaaagcaggggtgtgatatctgtcctggaaaactgggcagctgctaccgtggattgacggatctccacgaaagaagggaatgcgaccatgcagatcaccgtcaagaccatcaaagatcatcgggttcgcactgtccagaccgccatgagcagcgccttggggattggttcccaggtagacatgctcgcccccggcggttccaccagctcgagttccggttcatgctgctcgtgctcgacctgcgcggtagtggcgcagcctcaagactgaacggctggtcagccccaggggcgtggcgctcatcgcgtcacgccccttctattcgctggacagggtgcgcgagctgaggaacatcgcggtgtgtgcgatgacgaggggcaggagcaagtctgtgcgggttgccaagtagccctgcgcgatggccatcacgctggccccgacggcggcgaagacacctccgatacgtcgcttcatgccgccgaattgcatcaggacgaataggactcccgcggtccacatccctccgggcatgcatctgggaaagatgaaccggaagatgatctcttcacaggagagctggagtactagcagcgtagcccccacggggagactcacctctactgacagacggatcgtcttcatccacccacccgagctggcatcgaccatttcggtggccatgcgcgaccggtggcctcgtgcctctcgctgcgtgtcgatccagccgagcagtccgtggacgctctccgctaggactcctgacgcgacagtctcaccaattcctaagcccacggcgaggaccgcgacgcccccctgcacggcaggctgtgtgacttggtggtcccaccaacccgccggcaggaccatgcgtgcgaggctgcacacgagcaggaggtggagggtcacgacgagcgacatctggaataccgcttgccgttcggcgatggtggcgttgggaaagagcggtaggccggcacgggcagcggcgctcgacagcttccgcaagagcggtttggagacgaagtagtaggcgacgtacagcgccagcgctgtcgcgatgatgatcatcggtctgccaccgagctgacccgccgatagccgtttctgttccaccaatactggctgttgtagatcaggtggcccagaacacaggcccagatcccccagaagatgaacaggatagtccccaaggcggcgagcgggatcttggagaggacctgtccccgtccgaacaccgagtggccgcaagcaaacaagagtgctcccacagcggtgagcgcgagccaggccggggttgctcgcagactgatcaccgggaccccgacccggaagccgacctcttctcctacagcgatgactagcaactgccacagcggcatgttctgaacggagcgcgcgactcgggctcgagtcacccacacgggctgttgagcgctcacatcaccactcaggtaccccggtgaggcacttcgcttagtactggggcccgatgtgcgagcattcgtgatgtgtcgcaggatccggttgtcaagccaagaggccagcagggctccggcgacagtgacgggtagcccgatcagcacgaggccccagccatgcggtgccgagaggtttctggccggcgtgcacgcgaggcaggcaaatgccatcactgccagcactacgacgtagatggtcgcataattcgacttgcgggtgacgttgccgaccatcttggccaaagtcgctggggaccagctgatgagtgcgatggtggtcagcaggaagcaggaccagacagacatccggcgcactcaggggtatgggtgcggctgtgggttttggaaaccgccatatgcggcgtagcgggggtgtgcccgcatgggtgcgctgggcagtgacagggcgagcagcccaggcgcccagagcctgacacagtgcagtcccagcccctggatctctatggtggtgaaatcttcgatgtacaggggtgacacacaggtgatgctgttgaccacgctctttaccagttccgcccccgtgtgggtgtcgtcaggtggcaggtcttcggcttgggcaatggtgcccgcgtcgaatttcgccacaactgattgcgcggcctgatagttcctcgcgtagtaggagacgttcgagtcgaggtcaagcatgtcctccgtggacatactggacgcgtcggcctcggcgtcgaaagacgtccataccgcgagcatccgaaccccgctgcactcgagaaacgccttgtacatggctgcttccagacccgcgtctgcacctaggccgacggcgacgaggggaagttggttgccactaccgaccatcatgcatgccacggtgaaatgcttgagcccgggagtcggaagccagtagaaacgcagttcgtggcttcggcccgctgcacgttccacgagccgctggatgcgctggaggcggggtccttcgacgcggatgcgcacaggtgacgaggctccataccacaggcccatcgcggcatctacctggatcaattcataagccgcggacagcgttgcggcgacgcgtgaagtgtggacggcggtgccggtcgtcacggccgttcccagccacggctcaccgtcgtgccgacgggggttgtaacccaggtaaaagaactgcgccgggatccactcctgccgggaggtcccgacacggggagtcttgacccatgtcatgggcaagtcgtcgcgataggtgtcgaacgcacctccagccactcgttgcgcgaagccgaatgcgcccagatcgagaacttcgtcctcggtccgggcgaggagttcctgacgagtcgcccagcgccgttcgaagggactatggagaatcccggtacccgcgcagtagcgctcgacggcctccgcgtagaccttgatctctgcctcaaactcgttcagccccaccccaccgatgtggtagctacccggcttggggtcgggccggtcaagcagtgcgtgcatccccgtgagttccccaccgttcacccgcacgcgggggccgagcgcggggtgcagcgagtagccgacggaagtcaccagcccgcatagcgggctgtaggtgcgccgcctgagccgggctgcggtctcgacggggtcgctatcctggcgaagcttcatcgctcgccccctgccgccagccactcacggatgtcgtagtacaggtccggagcggtttcaacctgcgctggtgcatcaaaacgggacataggtaggacgtcgttgtaggcgatctccatcgtcggtatgtagaccgacaacactttgttgcgcgtcgtgttgaggccgttgcgggcgatgctgacagcctcatgcgcgacgtgcgcggccaagatcgcgcgcaccgacgctgccacggccggcgctccggcccttacgcggtcggcagcggccacccgcatccaggacaggtagctctgccgttcgcgcaggttcatcgcgacccgctgctcgaaggtccggtaggacgaggtcgcaccagggacgacgtagggacccacgtacaaggccggcccgtctacagctgcgtggagccacgacaggtgggcgcgtcgggcgaacaggtcaagggcgcgcagcatagccgggttgttctgcgccagcgctaccacaaggagtggctgcaggtccggcgccgaacccagcaacgccaacatctgggaggcctcctgctccatgtgcaactcgtcggccgactgctcaagccgcaggcctgcgaagagggtggctgatggctgcgtgtcgtcagcgaggacggtagcctgcagcccctctccctcgagaatctgctggatatcgccggcgaggagcgcgtcgtcgctgaatacccacaccgggcgcgtctctctacctccatccatcttgtcctcaacgttttcgaccagcgcaccgatcgatgctaggtgggccatcacgtcgtcaagggccgcgcgggtcaatccgggcacccgggacacgatctcgggcggctgcagtccttggctcaacaagtccaaggccggccacagggtcccggtggcgtcgtcgtcctccagcgttgtgctctcggcgttccagacgcctcgacggaactccaccctgtccatcgagtaaggcaccatcatgaggcccggtgaaatgtggttggtcactttggctcctgtacagcctaggcttggacgcccacggtcatggtgtgggtcgcggtttggaaaatcccgtcgaggttgagtgcctgattgagttcgtcctcgtagaagcttgaggactcgactgaggcaagaccgagccccgtgcagaccaagttgatctgttgtgcgatcgccccgacttcttgaagggcgaacctcaaacccctggctccgtacttccgcatcgccctccacggcgagatgacgaacaccaagtgcactccggccgcatccgattgctccacggccggc

SEQ ID NO: 118 - DNA, 9859 bp, Propionibacterium acnes
ggggttttccttcatgttcctgattttatctgcccggtgtggcgttttcatctttgtgtgggtggttcgcctggggtcttggagtgtggtgacgcggtgatggtcacggtgacggtgactgtggcgcgtggcgggtgaggtggttctttcctggtctggtgtgtggcccaggtgagtgtggtgatgagggccagggtgaggatgatgaccagggtggggagtagtttgtctggccggtgtcgccgggcttggtggcgcggcatgtttttccagggtgtgtctccgaacaggtcgtcgtcggaggggtcgtcgtggttcatagggtggccttggcgatggtggtgggcgagtttggtccaggtgatggtgccgtcggaggcgatgtggcggtcggcgggcagggtgtggacggtccatccggcgtcggtgagggcggtggtgaaggatttcttgatggatcgtttgggtaggtcgatgggggcgtgggtgccgacccagatgcaccggtttttgaggtgggtggcgccgaggtggttcatgtcgcggaccatgttttgggtgagtgtgagggtgtcggggtcccattggacggggatgatgatgtggtctgcgatggtgatggcgtgttgccaggcggcgtcgaggtcgttgtttccggtgtcgaggatgatgacgtggaagcggcttcttagggcggtgatgatgcggtcgaggtcgtcggcggtggggggtgtgatgaggctgttgtggttgtcggtgatggtgggtaggcatgtgatggtggcccagccttctggttgccaggagatgtaggggccgaggtcgcggggttgggaggcgaatcctgggtgacgggctgcgcgggcgaggtcgatgacggtgttgtcggtgtggcggggtgcgcgggtggagagggtgccgcgtgggttgatttccacgacgacgatgtcgtcgtgtcctgctgtggtggcgagggcttgggcaaggatgacggccagcggggttttgccggtgccgcctttgaggttggcgagggtgatgatgtggtcggtgagttgggcgggtgcggcggtgtggtgagggttggcggtgaggttggcgatggtgaacagggcatcgagatcgtcggtggtgttctgctcggtgggttgggggtcgccggagatgatcgggtcggcgcggcgcggctgccatgccggcctcaccactgtcacgaccaccacgggtctgctggcgctgtgtgggtgtcgtcggcgatgactcacgatcggcagtctcaccatcgtctcggtgatgctcggctagcgctggacccggtcaagttcgggccggctcacccagtggtgatgactcggtcacagaaccgctgccggtcgttatctcggacgtctcgactcctccagtcctgatgggcgttggagccacctacacctactctcagaacgaccccgacctcgtgtggggcgggggcagatgtcacttgggccaatcgagagcccaggtgatggggaaagcaggggtgtgatatctgtcctggaaaactgggcagctgctaccgtggattgacggatctccacgaaagaagggaatgcgaccatgcagatcaccgtcaagaccatcaaagatcatcgggttcgcactgtccagaccgccatgagcagcgccttggggattggttcccaggtagacatgctcgcccccggcggttccaccagctcgagttccggttcatgctgctcgtgctcgacctgcgcggtagtggcgcagcctcaagactgaacggctggtcagccccaggggcgtggcgctcatcgcgtcacgccccttctattcgctggacagggtgcgcgagctgaggaacatcgcggtgtgtgcgatgacgaggggcaggagcaagtctgtgcgggttgccaagtagccctgcgcgatggccatcacgctggccccgacggcggcgaagacacctccgatacgtcgcttcatgccgccgaattgcatcaggacgaataggactcccgcggtccacatccctccgggcatgcatctgggaaagatgaaccggaagatgatctcttcacaggagagctggagtactagcagcgtagcccccacggggagactcacctctactgacagacggatcgtcttcatccacccacccgagctggcatcgaccatttcggtggccatgcgcgaccggtggcctcgtgcctctcgctgcgtgtcgatccagccgagcagtccgtggacgctctccgctaggactcctgacgcgacagtctcaccaattcctaagcccacggcgaggaccgcgacgcccccctgcacggcaggctgtgtgacttggtggtcccaccaacccgccggcaggaccatgcgtgcgaggctgcacacgagcaggaggtggagggtcacgacgagcgacatctggaataccgcttgccgttcggcgatggtggcgttgggaaagagcggtaggccggcacgggcagcggcgctcgacagcttccgcaagagcggtttggagacgaagtagtaggcgacgtacagcgccagcgctgtcgcgatgatgatcatcggtctgccaccgagctgacccgccgatagccgtttctgttccaccaatactggctgttgtagatcaggtggcccagaacacaggcccagatcccccagaagatgaacaggatagtccccaaggcggcgagcgggatcttggagaggacctgtccccgtccgaacaccgagtggccgcaagcaaacaagagtgctcccacagcggtgagcgcgagccaggccggggttgctcgcagactgatcaccgggaccccgacccggaagccgacctcttctcctacagcgatgactagcaactgccacagcggcatgttctgaacggagcgcgcgactcgggctcgagtcacccacacgggctgttgagcgctcacatcaccactcaggtaccccggtgaggcacttcgcttagtactggggcccgatgtgcgagcattcgtgatgtgtcgcaggatccggttgtcaagccaagaggccagcagggctccggcgacagtgacgggtagcccgatcagcacgaggccccagccatgcggtgccgagaggtttctggccggcgtgcacgcgaggcaggcaaatgccatcactgccagcactacgacgtagatggtcgcataattcgacttgcgggtgacgttgccgaccatcttggccaaagtcgctggggaccagctgatgagtgcgatggtggtcagcaggaagcaggaccagacagacatccggcgcactcaggggtatgggtgcggctgtgggttttggaaaccgccatatgcggcgtagcgggggtgtgcccgcatgggtgcgctgggcagtgacagggcgagcagcccaggcgcccagagcctgacacagtgcagtcccagcccctggatctctatggtggtgaaatcttcgatgtacaggggtgacacacaggtgatgctgttgaccacgctctttaccagttccgcccccgtgtgggtgtcgtcaggtggcaggtcttcggcttgggcaatggtgcccgcgtcgaatttcgccacaactgattgcgcggcctgatagttcctcgcgtagtaggagacgttcgagtcgaggtcaagcatgtcctccgtggacatactggacgcgtcggcctcggcgtcgaaagacgtccataccgcgagcatccgaaccccgctgcactcgagaaacgccttgtacatggctgcttccagacccgcgtctgcacctaggccgacggcgacgaggggaagttggttgccactaccgaccatcatgcatgccacggtgaaatgcttgagcccgggagtcggaagccagtagaaacgcagttcgtggcttcggcccgctgcacgttccacgagccgctggatgcgctggaggcggggtccttcgacgcggatgcgcacaggtgacgaggctccataccacaggcccatcgcggcatctacctggatcaattcataagccgcggacagcgttgcggcgacgcgtgaagtgtggacggcggtgccggtcgtcacggccgttcccagccacggctcaccgtcgtgccgacgggggttgtaacccaggtaaaagaactgcgccgggatccactcctgccgggaggtcccgacacggggagtcttgacccatgtcatgggcaagtcgtcgcgataggtgtcgaacgcacctccagccactcgttgcgcgaagccgaatgcgcccagatcgagaacttcgtcctcggtccgggcgaggagttcctgacgagtcgcccagcgccgttcgaagggactatggagaatcccggtacccgcgcagtagcgctcgacggcctccgcgtagaccttgatctctgcctcaaactcgttcagccccaccccaccgatgtggtagctacccggcttggggtcgggccggtcaagcagtgcgtgcatccccgtgagttccccaccgttcacccgcacgcgggggccgagcgcggggtgcagcgagtagccgacggaagtcaccagcccgcatagcgggctgtaggtgcgccgcctgagccgggctgcggtctcgacggggtcgctatcctggcgaagcttcatcgctcgccccctgccgccagccactcacggatgtcgtagtacaggtccggagcggtttcaacctgcgctggtgcatcaaaacgggacataggtaggacgtcgttgtaggcgatctccatcgtcggtatgtagaccgacaacactttgttgcgcgtcgtgttgaggccgttgcgggcgatgctgacagcctcatgcgcgacgtgcgcggccaagatcgcgcgcaccgacgctgccacggccggcgctccggcccttacgcggtcggcagcggccacccgcatccaggacaggtagctctgccgttcgcgcaggttcatcgcgacccgctgctcgaaggtccggtaggacgaggtcgcaccagggacgacgtagggacccacgtacaaggccggcccgtctacagctgcgtggagccacgacaggtgggcgcgtcgggcgaacaggtcaagggcgcgcagcatagccgggttgttctgcgccagcgctaccacaaggagtggctgcaggtccggcgccgaacccagcaacgccaacatctgggaggcctcctgctccatgtgcaactcgtcggccgactgctcaagccgcaggcctgcgaagagggtggctgatggctgcgtgtcgtcagcgaggacggtagcctgcagcccctctccctcgagaatctgctggatatcgccggcgaggagcgcgtcgtcgctgaatacccacaccgggcgcgtctctctacctccatccatcttgtcctcaacgttttcgaccagcgcaccgatcgatgctaggtgggccatcacgtcgtcaagggccgcgcgggtcaatccgggcacccgggacacgatctcgggcggctgcagtccttggctcaacaagtccaaggccggccacagggtcccggtggcgtcgtcgtcctccagcgttgtgctctcggcgttccagacgcctcgacggaactccaccctgtccatcgagtaaggcaccatcatgaggcccggtgaaatgtggttggtcactttggctcctgtacagcctaggcttggacgcccacggtcatggtgtgggtcgcggtttggaaaatcccgtcgaggttgagtgcctgattgagttcgtcctcgtagaagcttgaggactcgactgaggcaagaccgagccccgtgcagaccaagttgatctgttgtgcgatcgccccgacttcttgaagggcgaacctcaaacccctggctccgtacttccgcatcgccctccacggcgagatgacgaacaccaagtgcactccggccgcatccgattgctccacggccggctcgccggccatcgaattcctcacgccgcgacagccctcttcaccggtcacgggcaccagtcgatcgatgaccggcgagtagcggtagacgccgcgactcaagccggacacccgttgtgcggacatgaagatagacacgggatacagccctccaccagacgggacagcgcgtacattataccgcacgatatcaccgctcgaacgtgggacatccacgtgccccgtcacaccggcagcacctctcagaaacgcagctacgtcacgcaggtctagggattcgccggtgtagttccgtccgctgcgccggcgggcgatcacttgctcgaggggtgcgcgcaccctgctggacctgggaagttcgatcacatcggcagcgaacgtgtcgcgatccatctgtccgtacgtaacgatcatggggtcaacgaaatagtcgccgaccgagacgttgaactccatatccccccgggcgatgcgcgaggcgagcaagaagtctgcagctgcgttagacagccccggcccatcagtgttgtcgcagcggaactcgtgggtccgaaaccccacaccttccgtgcccgggctctgcgctcgatacgacgtgatcgcagaactagccttccttaaaccgcccggagtagctaccatgaccgtcccctctgaggtctcccgaacacttgcgacaatagcagcatgtgggggcagccgccagaggcgggcatccttgtctcgacaaccattgacctccggattcgatatgtgcataatcatagtcgtgccaacacgaaacgtgtacgtctcggaagacgacctagacctgttcgccgaagccaccgagatcgctggaggcctgtccgcagcggtgttggaggccttgcgcagctacgtagacaggcaccatcgcgcggccggcggattcgacgagatcgagctggagctgcagaacgacggtatcgaccaccgtgtcaccttcatgggtcgccgcctgatacacatccgccgtccagatcccgagggaacccgcatagacactgtctacttgaccgccaaacaccaattcgccgttgccaccaaaatccaacgacggctgccagactggacggccggccacgagcacatctggtccgacccggagacctggaatcgggagttctggatcgcaggtgacaagacgatggccgtgtatcccagccttgacaaactccgcgaagctgaccccaatgtggccgaacgcgccgaggccgcggtcaaaatcccgccgttcgaggtcctggacatctgatgacagaatcatcatcttcccggcggcaattggcaatgccggtgctgtcagtcacggatctagccaagaaatacgtggttcatggcggctacgaggtcccggcactcaacggtgtctcgtttgacctgcacccgggagagatgctgggtttgttcgggccaaacggtgctggaaagacgacgctggtcaggatcatcgcgggcctcttatcggcagattctggagacgtccactggggatcggatcaaggtcgggccaggttaggctacgtgtcccaaaagggtggactgcagtacgggctcacgtgccgggaagagatggtcttccacgcacaatgcttcggccagtccgccaagcaggcccggactagcgtcgacgaggtcgccgcgatgctgcactgcgattacctgatggagtgggacgtcggaaggctctccggtgggcaacgccgaatcatcgaggtagggctagcactcgtcaatcaaccatcggtcgtcctgctcgacgagcccaccctgggcctggaccccgcaacacgcctgtcgttgtggcaaacggtaaagtcggcacgccgtgagaccggtgctgccttcctcgtcaccacccactacattgacgaggtggccgagcacctgtccaacgtcagcgtgatcaaccacggaaccgtcgtcgccaacggctcgccagcgcacatccgagaaatgttcgcgaccggggaagtaacgctcggcgtggccgaggatacggtggacagtgcggtggacgtgttggctgggaccgcgttcgaggcgcaccccaccgaaaccgtcccggggatcgtggtcaggtccaggcatcccgacgtggacgcggccaagatcatcaccatcctggctggtcatggcatctcggtggactccatatccgtacgcgaggcgaccttggaagaggcgtttctcacgatcacaggcagtcgagacccggagaggcaaatcccatgaacacttgcttcaggcgatatgcggcgatgtcgctgagagcgcggcgtgatttggccctgacattcatccagcccctcgtctacctagccctcttcggaccgctcttcgtcacgacgatgaagatgtcgcagagagctaccgccgctacgggttactccctatacatcacgggcctgtccatccaaatggccatgacgatcggtgccttcgcggggctaaccatcatcctcgaataccgactcggcatcctcgaacggatctggagcacccccctcacggggagcaagatgatggcggggcgaatcgcgcgcgacgtcgttatgatgatgatgccgatactggtcgtcttcatcatcggcctggtgctgggaacacgccccagcccactgggcctggcgacctacttcgtgacagtgctcggcacaggagccacgttcgccggggtctcctacgcggtggcactcagaacgaagagcgaggcagcgctatccgcgatcttcaacctcatcctgctacccatcctcctgctgtcggggatcatgctgcccatgtcgttcgcaccacactggatcgccaccgctgcccacgtgaacccgttgtggtacctggtgcaaggcgcgcggaaccagttcagcgttctagggctcgtggcggcggccccatggagttgggctgtggccatcgtcatgtcagccgctgccttcggctgggcaagccacgaattcaacaagaggcgctgacacaaagaatggtgccgggaacccaggtccccggcaccaccgagtgcactcgcgacgtcaacgcaccgttgcggtcactgcgcaggtcgagcacgaggacgacgagcccgcgctgctgcaggtcgagccgccaggcgcgagcaggtcgacgttagcgtcggcgccgccgaagacggacgtgacggccggctgagaggtgcggatgcggtgctccagcgaggaggtggtggtgagtttcatgggaggtgctcctaggagtgagacgagaacaaaccctagcgataggttagcagtccgcaaccgactccgggaatagtagaagcgcgcatccgtagcggaagaccttagcctgattacagtgaccctgttcgcgtctcaacattattccacacccccgagcagcgaacgacaccgcgatgatgatccgtcgcctctccaccgaagaactccgcgcccacatcgcaccgggccgccgtcccgtgcatcagacctgccgtcaacgtcggccatgaagctgggaaggtggctctcgtctaggagcagacgcgggacgcctcctccaggttgggccggggaagtgtccggttcttgatgtaggtggcggtccctattgatgggcgttgaccgtgggaatgcggtcggcgaagggggtggcgaacccgttgagcgcaggcttccagcgcatgcatcaacgctgtctgccggccaccggcaagcctcacccgcccgtcatggccatcatcgaggtgccggtgaatcctcgacacatgatcccaactcccccggaggggcttccggggctgttcagccaccagatcagccaggcggcgagcccgactctgccacccggaccctgcagagcgtgcctgctgccgtcgtgtcgtgtcgggccagtgggccaccagatcggccacatccgtcttggcccatct

SEQ ID NO: 119 - DNA, 9540 bp, Propionibacterium acnes
cggtgtggcggggtgcgcgggtggagagggtgccgcgtgggttgatttccacgacgacgatgtcgtcgtgtcctgctgtggtggcgagggcttgggcaaggatgacggccagcggggttttgccggtgccgcctttgaggttggcgagggtgatgatgtggtcggtgagttgggcgggtgcggcggtgtggtgagggttggcggtgaggttggcgatggtgaacagggcatcgagatcgtcggtggtgttctgctcggtgggttgggggtcgccggagatgatcgggtcggcgcggcgcggctgccatgccggcctcaccactgtcacgaccaccacgggtctgctggcgctgtgtgggtgtcgtcggcgatgactcacgatcggcagtctcaccatcgtctcggtgatgctcggctagcgctggacccggtcaagttcgggccggctcacccagtggtgatgactcggtcacagaaccgctgccggtcgttatctcggacgtctcgactcctccagtcctgatgggcgttggagccacctacacctactctcagaacgaccccgacctcgtgtggggcgggggcagatgtcacttgggccaatcgagagcccaggtgatggggaaagcaggggtgtgatatctgtcctggaaaactgggcagctgctaccgtggattgacggatctccacgaaagaagggaatgcgaccatgcagatcaccgtcaagaccatcaaagatcatcgggttcgcactgtccagaccgccatgagcagcgccttggggattggttcccaggtagacatgctcgcccccggcggttccaccagctcgagttccggttcatgctgctcgtgctcgacctgcgcggtagtggcgcagcctcaagactgaacggctggtcagccccaggggcgtggcgctcatcgcgtcacgccccttctattcgctggacagggtgcgcgagctgaggaacatcgcggtgtgtgcgatgacgaggggcaggagcaagtctgtgcgggttgccaagtagccctgcgcgatggccatcacgctggccccgacggcggcgaagacacctccgatacgtcgcttcatgccgccgaattgcatcaggacgaataggactcccgcggtccacatccctccgggcatgcatctgggaaagatgaaccggaagatgatctcttcacaggagagctggagtactagcagcgtagcccccacggggagactcacctctactgacagacggatcgtcttcatccacccacccgagctggcatcgaccatttcggtggccatgcgcgaccggtggcctcgtgcctctcgctgcgtgtcgatccagccgagcagtccgtggacgctctccgctaggactcctgacgcgacagtctcaccaattcctaagcccacggcgaggaccgcgacgcccccctgcacggcaggctgtgtgacttggtggtcccaccaacccgccggcaggaccatgcgtgcgaggctgcacacgagcaggaggtggagggtcacgacgagcgacatctggaataccgcttgccgttcggcgatggtggcgttgggaaagagcggtaggccggcacgggcagcggcgctcgacagcttccgcaagagcggtttggagacgaagtagtaggcgacgtacagcgccagcgctgtcgcgatgatgatcatcggtctgccaccgagctgacccgccgatagccgtttctgttccaccaatactggctgttgtagatcaggtggcccagaacacaggcccagatcccccagaagatgaacaggatagtccccaaggcggcgagcgggatcttggagaggacctgtccccgtccgaacaccgagtggccgcaagcaaacaagagtgctcccacagcggtgagcgcgagccaggccggggttgctcgcagactgatcaccgggaccccgacccggaagccgacctcttctcctacagcgatgactagcaactgccacagcggcatgttctgaacggagcgcgcgactcgggctcgagtcacccacacgggctgttgagcgctcacatcaccactcaggtaccccggtgaggcacttcgcttagtactggggcccgatgtgcgagcattcgtgatgtgtcgcaggatccggttgtcaagccaagaggccagcagggctccggcgacagtgacgggtagcccgatcagcacgaggccccagccatgcggtgccgagaggtttctggccggcgtgcacgcgaggcaggcaaatgccatcactgccagcactacgacgtagatggtcgcataattcgacttgcgggtgacgttgccgaccatcttggccaaagtcgctggggaccagctgatgagtgcgatggtggtcagcaggaagcaggaccagacagacatccggcgcactcaggggtatgggtgcggctgtgggttttggaaaccgccatatgcggcgtagcgggggtgtgcccgcatgggtgcgctgggcagtgacagggcgagcagcccaggcgcccagagcctgacacagtgcagtcccagcccctggatctctatggtggtgaaatcttcgatgtacaggggtgacacacaggtgatgctgttgaccacgctctttaccagttccgcccccgtgtgggtgtcgtcaggtggcaggtcttcggcttgggcaatggtgcccgcgtcgaatttcgccacaactgattgcgcggcctgatagttcctcgcgtagtaggagacgttcgagtcgaggtcaagcatgtcctccgtggacatactggacgcgtcggcctcggcgtcgaaagacgtccataccgcgagcatccgaaccccgctgcactcgagaaacgccttgtacatggctgcttccagacccgcgtctgcacctaggccgacggcgacgaggggaagttggttgccactaccgaccatcatgcatgccacggtgaaatgcttgagcccgggagtcggaagccagtagaaacgcagttcgtggcttcggcccgctgcacgttccacgagccgctggatgcgctggaggcggggtccttcgacgcggatgcgcacaggtgacgaggctccataccacaggcccatcgcggcatctacctggatcaattcataagccgcggacagcgttgcggcgacgcgtgaagtgtggacggcggtgccggtcgtcacggccgttcccagccacggctcaccgtcgtgccgacgggggttgtaacccaggtaaaagaactgcgccgggatccactcctgccgggaggtcccgacacggggagtcttgacccatgtcatgggcaagtcgtcgcgataggtgtcgaacgcacctccagccactcgttgcgcgaagccgaatgcgcccagatcgagaacttcgtcctcggtccgggcgaggagttcctgacgagtcgcccagcgccgttcgaagggactatggagaatcccggtacccgcgcagtagcgctcgacggcctccgcgtagaccttgatctctgcctcaaactcgttcagccccaccccaccgatgtggtagctacccggcttggggtcgggccggtcaagcagtgcgtgcatccccgtgagttccccaccgttcacccgcacgcgggggccgagcgcggggtgcagcgagtagccgacggaagtcaccagcccgcatagcgggctgtaggtgcgccgcctgagccgggctgcggtctcgacggggtcgctatcctggcgaagcttcatcgctcgccccctgccgccagccactcacggatgtcgtagtacaggtccggagcggtttcaacctgcgctggtgcatcaaaacgggacataggtaggacgtcgttgtaggcgatctccatcgtcggtatgtagaccgacaacactttgttgcgcgtcgtgttgaggccgttgcgggcgatgctgacagcctcatgcgcgacgtgcgcggccaagatcgcgcgcaccgacgctgccacggccggcgctccggcccttacgcggtcggcagcggccacccgcatccaggacaggtagctctgccgttcgcgcaggttcatcgcgacccgctgctcgaaggtccggtaggacgaggtcgcaccagggacgacgtagggacccacgtacaaggccggcccgtctacagctgcgtggagccacgacaggtgggcgcgtcgggcgaacaggtcaagggcgcgcagcatagccgggttgttctgcgccagcgctaccacaaggagtggctgcaggtccggcgccgaacccagcaacgccaacatctgggaggcctcctgctccatgtgcaactcgtcggccgactgctcaagccgcaggcctgcgaagagggtggctgatggctgcgtgtcgtcagcgaggacggtagcctgcagcccctctccctcgagaatctgctggatatcgccggcgaggagcgcgtcgtcgctgaatacccacaccgggcgcgtctctctacctccatccatcttgtcctcaacgttttcgaccagcgcaccgatcgatgctaggtgggccatcacgtcgtcaagggccgcgcgggtcaatccgggcacccgggacacgatctcgggcggctgcagtccttggctcaacaagtccaaggccggccacagggtcccggtggcgtcgtcgtcctccagcgttgtgctctcggcgttccagacgcctcgacggaactccaccctgtccatcgagtaaggcaccatcatgaggcccggtgaaatgtggttggtcactttggctcctgtacagcctaggcttggacgcccacggtcatggtgtgggtcgcggtttggaaaatcccgtcgaggttgagtgcctgattgagttcgtcctcgtagaagcttgaggactcgactgaggcaagaccgagccccgtgcagaccaagttgatctgttgtgcgatcgccccgacttcttgaagggcgaacctcaaacccctggctccgtacttccgcatcgccctccacggcgagatgacgaacaccaagtgcactccggccgcatccgattgctccacggccggctcgccggccatcgaattcctcacgccgcgacagccctcttcaccggtcacgggcaccagtcgatcgatgaccggcgagtagcggtagacgccgcgactcaagccggacacccgttgtgcggacatgaagatagacacgggatacagccctccaccagacgggacagcgcgtacattataccgcacgatatcaccgctcgaacgtgggacatccacgtgccccgtcacaccggcagcacctctcagaaacgcagctacgtcacgcaggtctagggattcgccggtgtagttccgtccgctgcgccggcgggcgatcacttgctcgaggggtgcgcgcaccctgctggacctgggaagttcgatcacatcggcagcgaacgtgtcgcgatccatctgtccgtacgtaacgatcatggggtcaacgaaatagtcgccgaccgagacgttgaactccatatccccccgggcgatgcgcgaggcgagcaagaagtctgcagctgcgttagacagccccggcccatcagtgttgtcgcagcggaactcgtgggtccgaaaccccacaccttccgtgcccgggctctgcgctcgatacgacgtgatcgcagaactagccttccttaaaccgcccggagtagctaccatgaccgtcccctctgaggtctcccgaacacttgcgacaatagcagcatgtgggggcagccgccagaggcgggcatccttgtctcgacaaccattgacctccggattcgatatgtgcataatcatagtcgtgccaacacgaaacgtgtacgtctcggaagacgacctagacctgttcgccgaagccaccgagatcgctggaggcctgtccgcagcggtgttggaggccttgcgcagctacgtagacaggcaccatcgcgcggccggcggattcgacgagatcgagctggagctgcagaacgacggtatcgaccaccgtgtcaccttcatgggtcgccgcctgatacacatccgccgtccagatcccgagggaacccgcatagacactgtctacttgaccgccaaacaccaattcgccgttgccaccaaaatccaacgacggctgccagactggacggccggccacgagcacatctggtccgacccggagacctggaatcgggagttctggatcgcaggtgacaagacgatggccgtgtatcccagccttgacaaactccgcgaagctgaccccaatgtggccgaacgcgccgaggccgcggtcaaaatcccgccgttcgaggtcctggacatctgatgacagaatcatcatcttcccggcggcaattggcaatgccggtgctgtcagtcacggatctagccaagaaatacgtggttcatggcggctacgaggtcccggcactcaacggtgtctcgtttgacctgcacccgggagagatgctgggtttgttcgggccaaacggtgctggaaagacgacgctggtcaggatcatcgcgggcctcttatcggcagattctggagacgtccactggggatcggatcaaggtcgggccaggttaggctacgtgtcccaaaagggtggactgcagtacgggctcacgtgccgggaagagatggtcttccacgcacaatgcttcggccagtccgccaagcaggcccggactagcgtcgacgaggtcgccgcgatgctgcactgcgattacctgatggagtgggacgtcggaaggctctccggtgggcaacgccgaatcatcgaggtagggctagcactcgtcaatcaaccatcggtcgtcctgctcgacgagcccaccctgggcctggaccccgcaacacgcctgtcgttgtggcaaacggtaaagtcggcacgccgtgagaccggtgctgccttcctcgtcaccacccactacattgacgaggtggccgagcacctgtccaacgtcagcgtgatcaaccacggaaccgtcgtcgccaacggctcgccagcgcacatccgagaaatgttcgcgaccggggaagtaacgctcggcgtggccgaggatacggtggacagtgcggtggacgtgttggctgggaccgcgttcgaggcgcaccccaccgaaaccgtcccggggatcgtggtcaggtccaggcatcccgacgtggacgcggccaagatcatcaccatcctggctggtcatggcatctcggtggactccatatccgtacgcgaggcgaccttggaagaggcgtttctcacgatcacaggcagtcgagacccggagaggcaaatcccatgaacacttgcttcaggcgatatgcggcgatgtcgctgagagcgcggcgtgatttggccctgacattcatccagcccctcgtctacctagccctcttcggaccgctcttcgtcacgacgatgaagatgtcgcagagagctaccgccgctacgggttactccctatacatcacgggcctgtccatccaaatggccatgacgatcggtgccttcgcggggctaaccatcatcctcgaataccgactcggcatcctcgaacggatctggagcacccccctcacggggagcaagatgatggcggggcgaatcgcgcgcgacgtcgttatgatgatgatgccgatactggtcgtcttcatcatcggcctggtgctgggaacacgccccagcccactgggcctggcgacctacttcgtgacagtgctcggcacaggagccacgttcgccggggtctcctacgcggtggcactcagaacgaagagcgaggcagcgctatccgcgatcttcaacctcatcctgctacccatcctcctgctgtcggggatcatgctgcccatgtcgttcgcaccacactggatcgccaccgctgcccacgtgaacccgttgtggtacctggtgcaaggcgcgcggaaccagttcagcgttctagggctcgtggcggcggccccatggagttgggctgtggccatcgtcatgtcagccgctgccttcggctgggcaagccacgaattcaacaagaggcgctgacacaaagaatggtgccgggaacccaggtccccggcaccaccgagtgcactcgcgacgtcaacgcaccgttgcggtcactgcgcaggtcgagcacgaggacgacgagcccgcgctgctgcaggtcgagccgccaggcgcgagcaggtcgacgttagcgtcggcgccgccgaagacggacgtgacggccggctgagaggtgcggatgcggtgctccagcgaggaggtggtggtgagtttcatgggaggtgctcctaggagtgagacgagaacaaaccctagcgataggttagcagtccgcaaccgactccgggaatagtagaagcgcgcatccgtagcggaagaccttagcctgattacagtgaccctgttcgcgtctcaacattattccacacccccgagcagcgaacgacaccgcgatgatgatccgtcgcctctccaccgaagaactccgcgcccacatcgcaccgggccgccgtcccgtgcatcagacctgccgtcaacgtcggccatgaagctgggaaggtggctctcgtctaggagcagacgcgggacgcctcctccaggttgggccggggaagtgtccggttcttgatgtaggtggcggtccctattgatgggcgttgaccgtgggaatgcggtcggcgaagggggtggcgaacccgttgagcgcaggcttccagcgcatgcatcaacgctgtctgccggccaccggcaagcctcacccgcccgtcatggccatcatcgaggtgccggtgaatcctcgacacatgatcccaactcccccggaggggcttccggggctgttcagccaccagatcagccaggcggcgagcccgactctgccacccggaccctgcagagcgtgcctgctgccgtcgtgtcgtgtcgggccagtgggccaccagatcggccacatccgtcttggcccatctccagcccgccagacccagggaggccatcacctcatcgacgccgcgccgggtggtctcatcaaccccgtcaaacagctcgggccacctcgatgatgccgtccgtgaacgatccagattcatgacatgctcctcttcacagatgccgacgacgatcaggccgtggccgtggcaacggggtgacctgccggcgcggctcacgacgttgagccggaaccacacgagacgcaccagtgtgctgcgccgtcttgagtcgggcgctgtactgggccctggcgctgtggtgaacagcccgacgaagcaccgaccgccggctgtcctcatcgccagggcgaggcatggggcgcggcatggtgcgcccggtagcagcatccatgagggtgatccggtcagccaaaatgccgagccggttttcccacttccggggccacggcaccagcaggtcacgctgacagcccacgccgtggcgtcggcagtccacaacattttctcacggccaggatgcgagtgcagcagctccaccggaacaccagcatcacgcacccgccgcatcgtgacctcatcctcacg

SEQ ID NO: 120 - DNA, 1583 bp, Propionibacterium acnes
accagatcggccacatccgtcttggcccatctccagcccgccagacccagggaggccatcacctcatcgacgccgcgccgggtggtctcatcaaccccgtcaaacagctcgggccacctcgatgatgccgtccgtgaacgatccagattcatgacatgctcctcttcacagatgccgacgacgatcaggccgtggccgtggcaacggggtgacctgccggcgcggctcacgacgttgagccggaaccacacgagacgcaccagtgtgctgcgccgtcttgagtcgggcgctgtactgggccctggcgctgtggtgaacagcccgacgaagcaccgaccgccggctgtcctcatcgccagggcgaggcatggggcgcggcatggtgcgcccggtagcagcatccatgagggtgatccggtcagccaaaatgccgagccggttttcccacttccggggccacggcaccagcaggtcacgctgacagcccacgccgtggcgtcggcagtccacaacattttctcacggccaggatgcgagtgcagcagctccaccggaacaccagcatcacgcacccgccgcatcgtgacctcatcctcacgctgccgatcaccgtcaaccagatggtcagccacgatggtgttcacaccccatgactcatgcagttgcctggccaaggcgcccaacacctgctgacgcacctgtgacttgacgtcatcatcctccagatcctgtgtaccaaccatcacggaggccaacacatcactgcgttgctgaaccagggtgttgacgacgtcgacatcgtcgatacccatgggattgttggcgcgcgcggccacggcatgaaacgtgttggactgcaaattctcgaccagaccacgccgatagtcgttgaactgggaggtgtcggcaatgacaccggtcatgatgtaggccgacccctcggacaaggccctgtaggactcgtcgacgaacgccaccaaccccggccgccgccggtaaagtcgacctgcttcctcgtcagccagcaaccatgacagtttttgccccatatgtcctccttgctgacatgacctcgaacatggtaaactttccgtaggaaaaacggggcaagtactttcgagcggctacctcggcccccggtgggctgtccagccttgtgcggaccgaagccgggggattccttatgtttgcggcaatgatgccgctgcaccccctcatgccgtggtgtggtcctttccccgtgtgcggtgtggtgcgtcgttgactggtttgtggccccgagccttactctgaccggtaggagaacggtgtggggtctacggatagcccactcggctcccggtggaatgtccaacagggtagggttgatgagttggtccatcaggaccgtcccggtggctgcgtcaatgatcgatatttcgatgatgcgcccgtccaggtcggtggtttcggtgtcgaggatgactccgactccgggttctaggagttggggatccaatgggtggtcatcgtgtggctcctacagggagtgtctgggctggacagcggtgcaatacccgcgccatagcggttttttctgcggg

SEQ ID NO: 121 - DNA, 6610 bp, Propionibacterium acnes
gtgttccagtgcctcgcgggcgtgatgttcttcttcggcaccttcttgccacatgcttcgcgcttcagcctcgccatccaagcgaacctggactgtgaacgagtcctcatcgggtccgtcctcattccacgcggcaatgatcccacgggcctcgtctgcgacctgactcaacttcatcgcctgcccgacagccccgagagccggaatctcgaacacccagatattcgcctcagccgagacctcacgatgggcgatcacttcgtaggtcgtctcaccttctactgtcgtgtccattacttccactccttcggaattttcacgcctgctcgctccagctgtgccaggacaccaactgacgtcagctggtgtcctgctggtatcgatacgcgcccggctccgccggggcgtccccagatttcatggcttcccttggcgttccgcagacgggcccatccttgagaacggagcagcttgaggacgtccttagttttctgcggtttcacacatcatagtatagccccacttaacttgtaaactaagcccctgtttacattttagttggtgcatgtgatccctgctcttatgacgtcgcccgacctggcgccttagacatgcactgttcatcctcaaccacactcaccgtcacgggtccgaaggcgaggtctatcaccattcgcatcgatgaagttgaagcaggatcgtccgcatcacgcactgccgatccggacagacgccaccggccgtaccgactgtttacgatctgccaccgcagactgctgccataaccgctatcacctctgatagtacgtttagtactatcagaggtgattcaagattctcctgtcgagcagccctacagtcacgaagtcctgcgatcgtcatcgcttaaggcagacggatggccatcggggaccactcgcaaagcaggggcgatcagcaacagtgatgtgccatgagcaagtactggtgcaccggctgtttactccgcccctagataaaccacgggtgcaggggtggacaccacaccatgaccgatgtggtgcccaccccatggctcacaggcaggccctatcgccgggagcactgctgcagatgaggctcagtaacctgccatgtctcacctggggccaaggtgccaagctccccacggaatctcaggcatcggaaaccagcagccgaacttccacagcatgagcgccctacgaaaaagcaggccgccgacggttctcaagaactcgccggcggcctgcatcgccactcgaactgtaaccgtggtccgaccccgtgcacaggtaagctccacactcccaccaggcatggccgaggcagtaccaagttgccgtggcccatcggcagatttggttaaattttgaaaagtcatatagactccttctgtaaatttttaaatctcataggactctcgccatcgccagccagcttcgacaggagtcccgatgtttcaccgagtgaaatatcggcaccgtttgagttgacctaaagctcaaaagatgctagaatccatcttacctcgttaggggcgttttgtcaaacgcccctatattgcgtgtcttcgcgcgtcgtagcgctgatgctgcgcctgtgtcgactatccgtttgtaagtactttcgatgacaccagcagtggctactcatgactggtgcgtgcgggtctaaagcagcagggaaaggaatcgcagtagaagccgcttgattcctatcacccctgatggtactatcagtactaacagagcagggcttactcgatgcgtgagaatcggggacatgctgagcctctcgtaggtcattggcctgctgggcgtcagtgtggcgcggttcgatccagtgaactctatcagctctgttagtactgtcagagttgatatattcgaccccaggaggagcccatgagttacatcgttcgcaccggaaatttggtcgacacccccgagctgcgtgagggagagcatggcccgtacacctacgctcgcgtcatcgtgtccgatcgcattcgccaggaggacggcagctacgtcaacgggccagcgatcgcctacgacgtcttggcgggtggcagccaagccgtgaatctggttgaagccgccaaggcgagcggcaacatccgcatcatgttcgcgggccgttaccgcgtcaccgagtggcggggtgagcagggcactcgtatccagcatgaggtccgagccgacgaagtgagcgtgagcctgctcggtcagagggtgaccgtggagcggcctcgaggtgacgtggcatccaaggagagcacgtcgttctgattgagtccgggggcacggtggtcgccgtggtaaaccgtgcccctgacagtactattgacactattggaggtatcagtgtgactgctcaaattttcgccttgtgcaaccagaagggtggcgtcggaaagtcgacatcgacgtttcatctggcccgtgccgcggtgttgcgtggccagcgtgtgcttgtcgtcgacaacgacccccagggcaacctgacgtctgtcgcggccgccgagcccgtgggggaggatcaggcggggctggccgatgtgctcagcgcgcgtgctccagagaccctccgcgatgtgatcgtgccgggaatctggtctggcctcgatgtcgtgccgacgtctggcatcacgctcggctgggtgcgtgacgaactcgtgatcgccggtgccggccgagaaggccggctgcgggaggccctggccggcgtcgaggacgactacgacgtgatcctgatcgactgtgctccatcgctcgatcagctcacgatcaacggcctggtggccgcccagggtgtcatcgtcgtgacgcactcgaagttgtggagcgccaacggcctcgcccagctgctcgacaccatcgacagcgtgcgcagctactacaacggcgcgctgcgcgtggcgggcatcatcgtcaaccagcacgaggagaacaccatcagcgggaaaacctggctcgacgagctgcatcaggctgccgagtcccggaagctgaccgtgcttgacccgccgatccccaagcgtgtcgtcatcgccgataccgtcgaggccgcgcgcggtctcgacgagtggggaagtgccgaggcggccgcgctcggccagttgtacgcccaccacctgacctgcatcgaaggagccctgtgatgacccgtccagccccccgaaagtcctcattgagcggatcaactccggtcgccccgccggctcagacggcgccggcaccgtctgccgcacctaccccccacaaggccgatgagtcacagacgagcagcaccacgaggaagtggcggcacaaggtgtcgttctaccaggacccggccgacaccgaccgggtgcgcggggcgatcctttacacgatgacgaccgagggcaaccggaacctgagccagttcgtcaacgatgccgtcatggccaaggtggtcgagctggaagtcaagtacaacgatggccagccattccccgctgtgggagcccgaggactaccccagggcggtgcagccgccgccggtgagtagaggaccatcgaccgtcgggggcttcaccatgcccccgaccctcggtcatcctgatcctcttgtcgatggtggtgacagtgggggattcacgcctcgttcagatcagaggaagtctcaccgcgtgattagtactatcaaatctgacagtactaacagagcagatagggttccctaggtcgagctgtatcacgccgacaaccagtgagccagtgatctacgaggggcgcaatatgcacccgatcggtagccgcgaaggcctcgccctgccccgatagtactatcaccactatcaatggtgctagtggtgagtttcttccattgatgacaacagcacagtgctgccgtctgtgtgcgggccaccagcccgcacacagttgccgtcgaggacgttgttcatgctctgtggtggccggtcctgagggcggctcgcaggatctcccggcgctcacggcgacgagcctggtagccaaggtctgcatgttcggcggcgagacgggctttgagggttgcggcttctgcacggcggtggagttggtcgtcgatgagttgggcgcgggccagacgccgcttatgggggttgtcgtgggtgaggggggcgtcgaggctgccgtcgtgggttagggccagggctgctcgttcggcgtcgtcgaggccgatgtggtggacggtcacgggtgcggtggtgacgtcgaggatgtccaggtggatgttgtggccgccgccgggggcttcggggaagtctggtgggctggcctggccggtgtcggggtcataccaggacaggccgatgatctcggcccagggtgggggcgggcagacggctcgcagaagggtgtgggccaggaacgtgttgcgggccatgatgcctccaagggtgaaaagcagtcgagtagcgatgacggcggggtagccgtctgctgggctgaggccgaccgggcccatgtcctcgatgctcttgtgctgcggccataccccaaagctaccaaacagtctttttaatctcaaagatacaaacagtgcttgacatattatctgcagcgaaagatactttcatcatggtggctgatcatgattacgcgactcctgacgatgagtggatgacacctcctcaggtggcccgtgtgattccgaacaccactgctcaggctgtccggcgctgggctgaggagggtcagcttcctggggcgtttcgtactccttctgggcgttggcatattccgtggtcggctgtggtgggcatcatggggtttgatccgcgtgagtccgcatcaccgagtgatcgtcaccagagctgacagagtcgtcgatgagctttcgagtgcagagctgatggcacgacggtctggatacttgtggagatgagagacgaccacatccagtcatggtcggggtacaccgaggggcagattcagcagtgctggcacgatgaggttgcccctgccattgactcgctcatggagcaggtaaggtctgttgccgagactcctgtgccgccgggttcgagattttacggcgatgagcagtgggccaagccttttcatccgtctactgcgatctgcggttcaatgggtccgccagcgatcacttgcacgcgctgaagctcctcgtctgggaagcgaacgtccaccatgtctatgcgccgtacacccttgctcgtgcatctattgaggcatcgtctactgctgtgtggctgttgagcacgaagacgcgcggagaacgtgtgctgcgagccttgcgatggtacgcgcaggattgtcacgactcgtgcaggttcatggatgatgagcagtatcgtgaccacctattgcggcgcattgaggggactgtcgctgcgggaaatctcgactcgcgcgctgctaggaaacggtaccgtgcaaccgatgttgtcgatgaggctgatcagctggttcccggaactctgagggcgtggcgagctttttctggtatggcccattcccgtatgtgggcatccagggggctgctcgacatggaagtgctgtccagtggccaaggaatggttacggcgaaggtgacgagcggatcggcccaaatcctttgggccgtcgtggcagctctgaatgttgctctcagtgccgctcgcttgtggcgtgattcgatgtgctcaccgtttgctgttgcccagtcggtagacgcgatgccagaggcgtttcgccgccctgtttagggtctgatcggggtagtgggtgttcacggggtcccaggttggccatggggcggcttggtgatgtgagttgggttgtgtggcagcctgggtgttgggtgtggcttcgttggccacgaaggcatgctcttccttgtgctgggacttgagtccccagtgctctcccctttgctagtggggggtggggtccccggaggtaggtcctccggggactttttctatgtctgtccgtgccccaggatttcgtatctaggcagtaccaattttgggttagttggaggtttctttggtaatggacagggtgagggtgatgaagaggtggccgtccttggtggcagaaattttctcgaacttcagctgaatgttgttatcagccactatctgttgggcggtgaggtgctcggagagcttctggaatccttcgcggatccacaggttgtaggggttggtgaccgagaccgaagggtatgggtcgaccttcagcgtcaggactggctggtctgggttgagggagttgatcttcaccagtttggggtaccggtcgcactcatgtgtctcttgtgttgggggccagcagtcgggggcccattcctcccagtggtcacgcatctcacgaagtactttcctgcatctcagcctctgcaggagctcgcgcgccaccgatgggagggctgccatgatgagggcaaggactgcgaacccgatgatgtaattgaccgtgtccctcgtcacgccgttcttgccgaggattccgatggcgaacgcgatgacgacaccgcccaggcacaggtgcatggggtcatgctgtgatggtttttcttcttcagcgactggtggggctatagtcatgtgtgccccttagtactaagtgatactggtgggttgcttttcccc

SEQ ID NO: 122 - DNA, 4467 bp, Propionibacterium acnes
cgcgcgcggtctcgacgagtggggaagtgccgaggcggccgcgctcggccagttgtacgcccaccacctgacctgcatcgaaggagccctgtgatgacccgtccagccccccgaaagtcctcattgagcggatcaactccggtcgccccgccggctcagacggcgccggcaccgtctgccgcacctaccccccacaaggccgatgagtcacagacgagcagcaccacgaggaagtggcggcacaaggtgtcgttctaccaggacccggccgacaccgaccgggtgcgcggggcgatcctttacacgatgacgaccgagggcaaccggaacctgagccagttcgtcaacgatgccgtcatggccaaggtggtcgagctggaagtcaagtacaacgatggccagccattccccgctgtgggagcccgaggactaccccagggcggtgcagccgccgccggtgagtagaggaccatcgaccgtcgggggcttcaccatgcccccgaccctcggtcatcctgatcctcttgtcgatggtggtgacagtgggggattcacgcctcgttcagatcagaggaagtctcaccgcgtgattagtactatcaaatctgacagtactaacagagcagatagggttccctaggtcgagctgtatcacgccgacaaccagtgagccagtgatctacgaggggcgcaatatgcacccgatcggtagccgcgaaggcctcgccctgccccgatagtactatcaccactatcaatggtgctagtggtgagtttcttccattgatgacaacagcacagtgctgccgtctgtgtgcgggccaccagcccgcacacagttgccgtcgaggacgttgttcatgctctgtggtggccggtcctgagggcggctcgcaggatctcccggcgctcacggcgacgagcctggtagccaaggtctgcatgttcggcggcgagacgggctttgagggttgcggcttctgcacggcggtggagttggtcgtcgatgagttgggcgcgggccagacgccgcttatgggggttgtcgtgggtgaggggggcgtcgaggctgccgtcgtgggttagggccagggctgctcgttcggcgtcgtcgaggccgatgtggtggacggtcacgggtgcggtggtgacgtcgaggatgtccaggtggatgttgtggccgccgccgggggcttcggggaagtctggtgggctggcctggccggtgtcggggtcataccaggacaggccgatgatctcggcccagggtgggggcgggcagacggctcgcagaagggtgtgggccaggaacgtgttgcgggccatgatgcctccaagggtgaaaagcagtcgagtagcgatgacggcggggtagccgtctgctgggctgaggccgaccgggcccatgtcctcgatgctcttgtgctgcggccataccccaaagctaccaaacagtctttttaatctcaaagatacaaacagtgcttgacatattatctgcagcgaaagatactttcatcatggtggctgatcatgattacgcgactcctgacgatgagtggatgacacctcctcaggtggcccgtgtgattccgaacaccactgctcaggctgtccggcgctgggctgaggagggtcagcttcctggggcgtttcgtactccttctgggcgttggcatattccgtggtcggctgtggtgggcatcatggggtttgatccgcgtgagtccgcatcaccgagtgatcgtcaccagagctgacagagtcgtcgatgagctttcgagtgcagagctgatggcacgacggtctggatacttgtggagatgagagacgaccacatccagtcatggtcggggtacaccgaggggcagattcagcagtgctggcacgatgaggttgcccctgccattgactcgctcatggagcaggtaaggtctgttgccgagactcctgtgccgccgggttcgagattttacggcgatgagcagtgggccaagccttttcatccgtctactgcgatctgcggttcaatgggtccgccagcgatcacttgcacgcgctgaagctcctcgtctgggaagcgaacgtccaccatgtctatgcgccgtacacccttgctcgtgcatctattgaggcatcgtctactgctgtgtggctgttgagcacgaagacgcgcggagaacgtgtgctgcgagccttgcgatggtacgcgcaggattgtcacgactcgtgcaggttcatggatgatgagcagtatcgtgaccacctattgcggcgcattgaggggactgtcgctgcgggaaatctcgactcgcgcgctgctaggaaacggtaccgtgcaaccgatgttgtcgatgaggctgatcagctggttcccggaactctgagggcgtggcgagctttttctggtatggcccattcccgtatgtgggcatccagggggctgctcgacatggaagtgctgtccagtggccaaggaatggttacggcgaaggtgacgagcggatcggcccaaatcctttgggccgtcgtggcagctctgaatgttgctctcagtgccgctcgcttgtggcgtgattcgatgtgctcaccgtttgctgttgcccagtcggtagacgcgatgccagaggcgtttcgccgccctgtttagggtctgatcggggtagtgggtgttcacggggtcccaggttggccatggggcggcttggtgatgtgagttgggttgtgtggcagcctgggtgttgggtgtggcttcgttggccacgaaggcatgctcttccttgtgctgggacttgagtccccagtgctctcccctttgctagtggggggtggggtccccggaggtaggtcctccggggactttttctatgtctgtccgtgccccaggatttcgtatctaggcagtaccaattttgggttagttggaggtttctttggtaatggacagggtgagggtgatgaagaggtggccgtccttggtggcagaaattttctcgaacttcagctgaatgttgttatcagccactatctgttgggcggtgaggtgctcggagagcttctggaatccttcgcggatccacaggttgtaggggttggtgaccgagaccgaagggtatgggtcgaccttcagcgtcaggactggctggtctgggttgagggagttgatcttcaccagtttggggtaccggtcgcactcatgtgtctcttgtgttgggggccagcagtcgggggcccattcctcccagtggtcacgcatctcacgaagtactttcctgcatctcagcctctgcaggagctcgcgcgccaccgatgggagggctgccatgatgagggcaaggactgcgaacccgatgatgtaattgaccgtgtccctcgtcacgccgttcttgccgaggattccgatggcgaacgcgatgacgacaccgcccaggcacaggtgcatggggtcatgctgtgatggtttttcttcttcagcgactggtggggctatagtcatgtgtgccccttagtactaagtgatactggtgggttgcttttccccggtggccgtgtgcaagacggccaccggggttttccttcatgttcctgattttatctgcccggtgtggcgttttcatctttgtgtgggtggttcgcctggggtcttggagtgtggtgacgcggtgatggtcacggtgacggtgactgtggcgcgtggcgggtgaggtggttctttcctggtctggtgtgtggcccaggtgagtgtggtgatgagggccagggtgaggatgatgaccagggtggggagtagtttgtctggccggtgtcgccgggcttggtggcgcggcatgtttttccagggtgtgtctccgaacaggtcgtcgtcggaggggtcgtcgtggttcatagggtggccttggcgatggtggtgggcgagtttggtccaggtgatggtgccgtcggaggcgatgtggcggtcggcgggcagggtgtggacggtccatccggcgtcggtgagggcggtggtgaaggatttcttgatggatcgtttgggtaggtcgatgggggcgtgggtgccgacccagatgcaccggtttttgaggtgggtggcgccgaggtggttcatgtcgcggaccatgttttgggtgagtgtgagggtgtcggggtcccattggacggggatgatgatgtggtctgcgatggtgatggcgtgttgccaggcggcgtcgaggtcgttgtttccggtgtcgaggatgatgacgtggaagcggcttcttagggcggtgatgatgcggtcgaggtcgtcggcggtggggggtgtgatgaggctgttgtggttgtcggtgatggtgggtaggcatgtgatggtggcccagccttctggttgccaggagatgtaggggccgaggtcgcggggttgggaggcgaatcctgggtgacgggctgcgcgggcgaggtcgatgacggtgttgtcggtgtggcggggtg

SEQ ID NO: 123 - DNA, 3927 bp, Propionibacterium acnes
gtgttccagtgcctcgcgggcgtgatgttcttcttcggcaccttcttgccacatgcttcgcgcttcagcctcgccatccaagcgaacctggactgtgaacgagtcctcatcgggtccgtcctcattccacgcggcaatgatcccacgggcctcgtctgcgacctgactcaacttcatcgcctgcccgacagccccgagagccggaatctcgaacacccagatattcgcctcagccgagacctcacgatgggcgatcacttcgtaggtcgtctcaccttctactgtcgtgtccattacttccactccttcggaattttcacgcctgctcgctccagctgtgccaggacaccaactgacgtcagctggtgtcctgctggtatcgatacgcgcccggctccgccggggcgtccccagatttcatggcttcccttggcgttccgcagacgggcccatccttgagaacggagcagcttgaggacgtccttagttttctgcggtttcacacatcatagtatagccccacttaacttgtaaactaagcccctgtttacattttagttggtgcatgtgatccctgctcttatgacgtcgcccgacctggcgccttagacatgcactgttcatcctcaaccacactcaccgtcacgggtccgaaggcgaggtctatcaccattcgcatcgatgaagttgaagcaggatcgtccgcatcacgcactgccgatccggacagacgccaccggccgtaccgactgtttacgatctgccaccgcagactgctgccataaccgctatcacctctgatagtacttttagtactatcagaggtgattcaagattctcctgtcgagcagccctacagtcacgaagtcctgcgatcgtcatcgcttaaggtagacggatggccatcggggaccactcgcaaagcaggggcgatcagcaacagtgatgtgccatgagcaagtactggtgcaccggctgtttactccgcccctagataaaccacgggtgcaggggtggacaccacaccatgaccgatgtggtgcccaccccatggctcacaggcaggccctatcgccgggagcactgctgcagatgaggctcagtaacctgccatgtctcacctggggccaaggtgccaagctccccacggaatctcaggcatcggaaaccagcagccgaacttccacagcatgagcgccctacgaaaaagcaggccgccgacggttctcaagaactcgccggcggcctgcatcgccactcgaactgtaaccgtggtccgaccccgtgcacaggtaagctccacactcccaccaggcatggccgaggcagtaccaagttgccgtggcccatcggcagatttggttaaattttgaaaagtcatatagactccttctgtaaatttttaaatctcataggactctcgccatcgccagccagcttcgacaggagtcccgatgtttcaccgagtgaaatatcggcaccgtttgagttgacctaaagctcaaaagatgctagaatccatcttacctcgttaggggcgttttgtcaaacgcccctatattgcgtgtcttcgcgcgtcgtagcgctgatgctgcgcctgtgtcgactatccgtttgtaagtactttcgatgacaccagcagtggctactcatgactggtgcgtgcgggtctaaagcagcagggaaaggaatcgcagtagaagccgcttgattcctatcacccctgatggtactatcagtactaacagagcagggcttactcgatgcgtgagaatcggggacatgctgagcctctcgtaggtcattggcctgctgggcgtcagtgtggcgcggttcgatccagtgaactctatcagctctgttagtactgtcagagttgatatattcgaccccaggaggagcccatgagttacatcgttcgcaccggaaatttggtcgacacccccgagctgcgtgagggagagcatggcccgtacacctacgctcgcgtcatcgtgtccgatcgcattcgccaggaggacggcagctacgtcaacgggccagcgatcgcctacgacgtcttggcgggtggcagccaagccgtgaatctggttgaagccgccaaggcgagcggcaacatccgcatcatgttcgcgggccgttaccgcgtcaccgagtggcggggtgagcagggcactcgtatccagcatgaggtccgagccgacgaagtgagcgtgagcctgctcggtcagagggtgaccgtggagcggcctcgaggtgacgtggcatccaaggagagcacgtcgttctgattgagtccgggggcacggtggtcgccgtggtaaaccgtgcccctgacagtactattgacactattggaggtatcagtgtgactgctcaaattttcgccttgtgcaaccagaagggtggcgtcggaaagtcgacatcgacgtttcatctggcccgtgccgcggtgttgcgtggccagcgtgtgcttgtcgtcgacaacgacccccagggcaacctgacgtctgtcgcggccgccgagcccgtgggggaggatcaggcggggctggccgatgtgctcagcgcgcgtgctccagagaccctccgcgatgtgatcgtgccgggaatctggtctggcctcgatgtcgtgccgacgtttggcatcacgctcggctgggtgcgtgacgaactcgtgatcgccggtgccggccgagaaggccggctgcgggaggccctggccggcgtcgaggacgactacgacgtgatcctgatcgactgtgctccatcgctcgatcagctcacgatcaacggcctggtggccgcccagggtgtcatcgtcgtgacgcactcgaagttgtggagcgccaacggcctcgcccagctgctcgacaccatcgacagcgtgcgcagctactacaacggcgcgctgcgcgtggcgggcatcatcgtcaaccagcacgaggagaacaccatcagcgggaaaacctggctcgacgagctgcatcaggctgccgagtcccggaagctgaccgtgcttgacccgccgatccccaagcgtgtcgtcatcgccgataccgtcgaggccgcgcgcggtctcgacgagtggggaagtgccgaggcggccgcgctcggccagttgtacgcccaccacctgacctgcatcgaaggagccctgtgatgacccgtccagccccccgaaagtcctcattgagcggatcaactccggtcgccccgccggctcagacggcgccggcaccgtctgccgcacctaccccccacaaggccgatgagtcacagacgagcagcaccacgaggaagtggcggcacaaggtgtcgttctaccaggacccggccgacaccgaccgggtgcgcggggcgatcctttacacgatgacgaccgagggcaaccggaacctgagccagttcgtcaacgatgccgtcatggccaaggtggtcgagctggaagtcaagtacaacgatggccagccattccccgctgtgggagcccgaggactaccccagggcggtgcagccgccgccggtgagtagaggaccatcgaccgtcgggggcttcaccatgcccccgaccctcggtcatcctgatcctcttgtcgatggtggtgacagtgggggattcacgcctcgttcagatcagaggaagtctcaccgcgtgattagtactatcaaatctgacagtactaacagagcagatagggttccctaggtcgagctgtatcacgccgacaaccagtgagccagtgatctacgaggggcgcaatatgcacccgatcggtagccgcgaaggcctcgccctgccccgatagtactatcaccactatcaatggtgctagtggtgagtttcttccattgatgacaacagcacagtgctgccgtctgtgtgcgggccaccagcccgcacacagttgccgtcgaggacgttgt

SEQ ID NO: 124 - DNA, 3842 bp, Propionibacterium acnes
cactccggccgcatccgattgctccacggccggctcgccggccatcgaattcctcacgccgcgacagccctcttcaccggtcacgggcaccagtcgatcgatgaccggcgagtagcggtagacgccgcgactcaagccggacacccgttgtgcggacatgaagatagacacgggatacagccctccaccagacgggacagcgcgtacattataccgcacgatatcaccgctcgaacgtgggacatccacgtgccccgtcacaccggcagcacctctcagaaacgcagctacgtcacgcaggtctagggattcgccggtgtagttccgtccgctgcgccggcgggcgatcacttgctcgaggggtgcgcgcaccctgctggacctgggaagttcgatcacatcggcagcgaacgtgtcgcgatccatctgtccgtacgtaacgatcatggggtcaacgaaatagtcgccgaccgagacgttgaactccatatccccccgggcgatgcgcgaggcgagcaagaagtctgcagctgcgttagacagccccggcccatcagtgttgtcgcagcggaactcgtgggtccgaaaccccacaccttccgtgcccgggctctgcgctcgatacgacgtgatcgcagaactagccttccttaaaccgcccggagtagctaccatgaccgtcccctctgaggtctcccgaacacttgcgacaatagcagcatgtgggggcagccgccagaggcgggcatccttgtctcgacaaccattgacctccggattcgatatgtgcataatcatagtcgtgccaacacgaaacgtgtacgtctcggaagacgacctagacctgttcgccgaagccaccgagatcgctggaggcctgtccgcagcggtgttggaggccttgcgcagctacgtagacaggcaccatcgcgcggccggcggattcgacgagatcgagctggagctgcagaacgacggtatcgaccaccgtgtcaccttcatgggtcgccgcctgatacacatccgccgtccagatcccgagggaacccgcatagacactgtctacttgaccgccaaacaccaattcgccgttgccaccaaaatccaacgacggctgccagactggacggccggccacgagcacatctggtccgacccggagacctggaatcgggagttctggatcgcaggtgacaagacgatggccgtgtatcccagccttgacaaactccgcgaagctgaccccaatgtggccgaacgcgccgaggccgcggtcaaaatcccgccgttcgaggtcctggacatctgatgacagaatcatcatcttcccggcggcaattggcaatgccggtgctgtcagtcacggatctagccaagaaatacgtggttcatggcggctacgaggtcccggcactcaacggtgtctcgtttgacctgcacccgggagagatgctgggtttgttcgggccaaacggtgctggaaagacgacgctggtcaggatcatcgcgggcctcttatcggcagattctggagacgtccactggggatcggatcaaggtcgggccaggttaggctacgtgtcccaaaagggtggactgcagtacgggctcacgtgccgggaagagatggtcttccacgcacaatgcttcggccagtccgccaagcaggcccggactagcgtcgacgaggtcgccgcgatgctgcactgcgattacctgatggagtgggacgtcggaaggctctccggtgggcaacgccgaatcatcgaggtagggctagcactcgtcaatcaaccatcggtcgtcctgctcgacgagcccaccctgggcctggaccccgcaacacgcctgtcgttgtggcaaacggtaaagtcggcacgccgtgagaccggtgctgccttcctcgtcaccacccactacattgacgaggtggccgagcacctgtccaacgtcagcgtgatcaaccacggaaccgtcgtcgccaacggctcgccagcgcacatccgagaaatgttcgcgaccggggaagtaacgctcggcgtggccgaggatacggtggacagtgcggtggacgtgttggctgggaccgcgttcgaggcgcaccccaccgaaaccgtcccggggatcgtggtcaggtccaggcatcccgacgtggacgcggccaagatcatcaccatcctggctggtcatggcatctcggtggactccatatccgtacgcgaggcgaccttggaagaggcgtttctcacgatcacaggcagtcgagacccggagaggcaaatcccatgaacacttgcttcaggcgatatgcggcgatgtcgctgagagcgcggcgtgatttggccctgacattcatccagcccctcgtctacctagccctcttcggaccgctcttcgtcacgacgatgaagatgtcgcagagagctaccgccgctacgggttactccctatacatcacgggcctgtccatccaaatggccatgacgatcggtgccttcgcggggctaaccatcatcctcgaataccgactcggcatcctcgaacggatctggagcacccccctcacggggagcaagatgatggcggggcgaatcgcgcgcgacgtcgttatgatgatgatgccgatactggtcgtcttcatcatcggcctggtgctgggaacacgccccagcccactgggcctggcgacctacttcgtgacagtgctcggcacaggagccacgttcgccggggtctcctacgcggtggcactcagaacgaagagcgaggcagcgctatccgcgatcttcaacctcatcctgctacccatcctcctgctgtcggggatcatgctgcccatgtcgttcgcaccacactggatcgccaccgctgcccacgtgaacccgttgtggtacctggtgcaaggcgcgcggaaccagttcagcgttctagggctcgtggcggcggccccatggagttgggctgtggccatcgtcatgtcagccgctgccttcggctgggcaagccacgaattcaacaagaggcgctgacacaaagaatggtgccgggaacccaggtccccggcaccaccgagtgcactcgcgacgtcaacgcaccgttgcggtcactgcgcaggtcgagcacgaggacgacgagcccgcgctgctgcaggtcgagccgccaggcgcgagcaggtcgacgttagcgtcggcgccgccgaagacggacgtgacggccggctgagaggtgcggatgcggtgctccagcgaggaggtggtggtgagtttcatgggaggtgctcctaggagtgagacgagaacaaaccctagcgataggttagcagtccgcaaccgactccgggaatagtagaagcgcgcatccgtagcggaagaccttagcctgattacagtgaccctgttcgcgtctcaacattattccacacccccgagcagcgaacgacaccgcgatgatgatccgtcgcctctccaccgaagaactccgcgcccacatcgcaccgggccgccgtcccgtgcatcagacctgccgtcaacgtcggccatgaagctgggaaggtggctctcgtctaggagcagacgcgggacgcctcctccaggttgggccggggaagtgtccggttcttgatgtaggtggcggtccctattgatgggcgttgaccgtgggaatgcggtcggcgaagggggtggcgaacccgttgagcgcaggcttccagcgcatgcatcaacgctgtctgccggccaccggcaagcctcacccgcccgtcatggccatcatcgaggtgccggtgaaccctcgacacatgaccccaccccccccggaggggcttccggggctgttcagccacc

SEQ ID NO: 125 - DNA, 3694 bp, Propionibacterium acnes
cacccgccgcatcgtgacctcatcctcacgtgccaccagcgggggagagcgactaccgctgcagccggtccaaagcgactcttcacagatgagggggtggatcggtagctgacccctaggtcctgatgtgggtcgaggtccttggaatgatggaagttcctacacacccatcgccaaagacctcaacatggacaacgctaccttcaccactccctcatctgtgaagagccagtttatgcacggtgttgaaagaggcgtcggtctacgacgaatgcgggttaatggtcttgcggtgtggggcgctgggcgatggcatcgagaacgcgtgagtgggtggcgatccattcggccgcgtcggggttgatgttgcgggcgacggtgtcgatcgctgttacgtagtgggcaagcctgcgaatctcagcttgttggtcagggtgagcgctgatgagaggctcttgatgggaggcgcggttacggacgtggcggatgagctccacgttttcctcgaagtcgcgtcggctacgccccgggtagtgaggcatacctccgttacgtaagtcagtgagagctttccatacggttgcttccaggcgcggggtgagcagaaagcgccagttgtccagtgacagactcgccacgatctgatcaggggtcgcatcgagcctcgcgcgccgcagtcgcttctcggccctggcgacgttacgcgggaaaccaccgagccgatagctcggggattcccaccaacgccgtatgccagtatcggcgctcaggcgcacgtcaatgaagtttctcaggagtacctcgacatggctgatgtcttccaagaacgctttcgagatgcgggtgttccacacgtaccacgcatcgactggttcgatccggtagcgtctgagcctggcgggtgagaaccactcctgcaacgtctcacgactcaccgtgggagcgtggtaggattgatgacgataggcctcgggaaggtcaatgccgcgaaatatcggtatacccccgaggtcattgttttgcccaggcccctcctcgcatacttgcggggcgtcattggctgccgtcatctcgtctcttcccggtacgtggctgtccatgttcacgggcaggtacggcaatgaggttcccgcacacaaacctctaccaagcatacgctggcaagcccccctctcggccccaccacaacatcaattgctgactcgaacacctttgaggcagcgctttcggcttgcgcaaccccacccacgacaccgtccgcttactactcgaagttgagggattcagaccccacctacaccctcgattgtgaagagcctccaaagcccgatacaacgtctggcgagacaccgtgaacgacctcgccaccgcagcaacgcaccagcagcgcgggatggcttggtattagcccagcgcagggcccccaggcaccagccctaacgaccccgcacccgacgtggctagaggataagccgcacgggaggactccatacccgccgactcattccagcccgccaccagccgagccatatgatcaaccgcccgcggtaaataatccagccactcacgccggtcgtacaaggaaccggccccgctccaggcgtgtgcccaggatcgccacaacacgtcgagctcgaccaccacgcccggaatagattcccactccaaatccggatcagcggccgccacgtaccagatcggccacatccgtcttggcccatctccagcccgccagacccagggaggccatcacctcatcgacgccgcgccgggtggtctcatcaaccccgtcaaacagctcgggccacctcgatgatgccgtccgtgaacgatccagattcatgacatgctcctcttcacagatgccgacgacgatcaggccgtggccgtggcaacggggtgacctgccggcgcggctcacgacgttgagccggaaccacacgagacgcaccagtgtgctgcgccgtcttgagtcgggcgctgtactgggccctggcgctgtggtgaacagcccgacgaagcaccgaccgccggctgtcctcatcgccagggcgaggcatggggcgcggcatggtgcgcccggtagcagcatccatgagggtgatccggtcagccaaaatgccgagccggttttcccacttccggggccacggcaccagcaggtcacgctgacagcccacgccgtggcgtcggcagtccacaacattttctcacggccaggatgcgagtgcagcagctccaccggaacaccagcatcacgcacccgccgcatcgtgacctcatcctcacgctgccgatcaccgtcaaccagatggtcagccacgatggtgttcacaccccatgactcatgcagttgcctggccaaggcgcccaacacctgctgacgcacctgtgacttgacgtcatcatcctccagatcctgtgtaccaaccatcacggaggccaacacatcactgcgttgcagaaccagggtgttgacgacgtcgacatcgtcgatacccatgggattgttggcgcgcgcggccacggcatgaaacgtgttggactgcaaattctcgaccagaccacgccgatagtcgttgaactgggaggtgtcggcaatgacaccggtcatgatgtaggccgacccctcggacaaggccctgtaggactcgtcgacgaacgccaccaaccccggccgccgccggtaaagtcgacctgcttcctcgtcagccagcaaccatgacagtttttgccccatatgtcctccttgctgacatgacctcgaacatggtaaactttccgtaggaaaaacggggcaagtactttcgagcggctacctcggcccccggtgggctgtccagccttgtgcggaccgaagccgggggattccttatgtttgcggcaatgatgccgctgcaccccctcatgccgtggtgtggtcctttccccgtgtgcggtgtggtgcgtcgttgactggtttgtggccccgagccttactctgaccggtaggagaacggtgtggggtctacggatagcccactcggctcccggtggaatgtccaacagggtagggttgatgagttggtccatcaggaccgtcccggtggctgcgtcaatgatcgatatttcgatgatgcgcccgtccaggtcggtggtttcggtgtcgaggatgactccgactccgggttctaggagttggggatccaatgggtggtcatcgtgtggctcctacagggagtgtctgggctggacagcggtgcaatacccgcgccatagcggttttttctgcgggggtgacccacagctggtatttcgttttgacggcgatttggcgggccacgtagtcgcatctgtaggccttgttagggggtagccaggtcgctgcatccctgtctcgtttggcctcattagcgggtccgtcgacagccagcaagttcaacgggtcgttggccagggcggtgcgttgcagcggtgagagtttttgcgcgccggtaatccacgcgttcccgagggctacgacgtggtcgatttggactgttgtcgaggtgtgccggccgcgccgccaggcgagtgtggacccggtgtaggggtcgtggagtcgcccggagacgaccacgcatcgtgatccgggtttcaggtgggcctcgaccaggtcgcgggcaagggcatcgttgcgggtgtcgcatccgttgtggccccaggggcgggtcaa

SEQ ID NO: 126 - DNA, 599 bp, Propionibacterium acnes; identical to SEQ ID NO: 100

SEQ ID NO: 127 - DNA, 3076 bp, Propionibacterium acnes
gtgttccagtgcctcgcgggcgtgatgttcttcttcggcaccttcttgccacatgcttcgcgcttcagcctcgccatccaagcgaacctggactgtgaacgagtcctcatcgggtccgtcctcattccacgcggcaatgatcccacgggcctcgtctgcgacctgactcaacttcatcgcctgcccgacagccccgagagccggaatctcgaacacccagatattcgcctcagccgagacctcacgatgggcgatcacttcgtaggtcgtctcaccttctactgtcgtgtccattacttccactccttcggaattttcacgcctgctcgctccagctgtgccaggacaccaactgacgtcagctggtgtcctgctggtatcgatacgcgcccggctccgccggggcgtccccagatttcatggcttcccttggcgttccgcagacgggcccatccttgagaacggagcagcttgaggacgtccttagttttctgcggtttcacacatcatagtatagccccacttaacttgtaaactaagcccctgtttacattttagttggtgcatgtgatccctgctcttatgacgtcgcccgacctggcgccttagacatgcactgttcatcctcaaccacactcaccgtcacgggtccgaaggcgaggtctatcaccattcgcatcgatgaagttgaagcaggatcgtccgcatcacgcactgccgatccggacagacgccaccggccgtaccgactgtttacgatctgccaccgcagactgctgccataaccgctatcacctctgatagtacgtttagtactatcagaggtgattcaagattctcctgtcgagcagccctacagtcacgaagtcctgcgatcgtcatcgcttaaggcagacggatggccatcggggaccactcgcaaagcaggggcgatcagcaacagtgatgtgccatgagcaagtactggtgcaccggctgtttactccgcccctagataaaccacgggtgcaggggtggacaccacaccatgaccgatgtggtgcccaccccatggctcacaggcaggccctatcgccgggagcactgctgcagatgaggctcagtaacctgccatgtctcacctggggccaaggtgccaagctccccacggaatctcaggcatcggaaaccagcagccgaacttccacagcatgagcgccctacgaaaaagcaggccgccgacggttctcaagaactcgccggcggcctgcatcgccactcgaactgtaaccgtggtccgaccccgtgcacaggtaagctccacactcccaccaggcatggccgaggcagtaccaagttgccgtggcccatcggcagatttggttaaattttgaaaagtcatatagactccttctgtaaatttttaaatctcataggactctcgccatcgccagccagcttcgacaggagtcccgatgtttcaccgagtgaaatatcggcaccgtttgagttgacctaaagctcaaaagatgctagaatccatcttacctcgttaggggcgttttgtcaaacgcccctatattgcgtgtcttcgcgcgtcgtagcgctgatgctgcgcctgtgtcgactatccgtttgtaagtactttcgatgacaccagcagtggctactcatgactggtgcgtgcgggtctaaagcagcagggaaaggaatcgcagtagaagccgcttgattcctatcacccctgatggtactatcagtactaacagagcagggcttactcgatgcgtgagaatcggggacatgctgagcctctcgtaggtcattggcctgctgggcgtcagtgtggcgcggttcgatccagtgaactctatcagctctgttagtactgtcagagttgatatattcgaccccaggaggagcccatgagttacatcgttcgcaccggaaatttggtcgacacccccgagctgcgtgagggagagcatggcccgtacacctacgctcgcgtcatcgtgtccgatcgcattcgccaggaggacggcagctacgtcaacgggccagcgatcgcctacgacgtcttggcgggtggcagccaagccgtgaatctggttgaagccgccaaggcgagcggcaacatccgcatcatgttcgcgggccgttaccgcgtcaccgagtggcggggtgagcagggcactcgtatccagcatgaggtccgagccgacgaagtgagcgtgagcctgctcggtcagagggtgaccgtggagcggcctcgaggtgacgtggcatccaaggagagcacgtcgttctgattgagtccgggggcacggtggtcgccgtggtaaaccgtgcccctgacagtactattgacactattggaggtatcagtgtgactgctcaaattttcgccttgtgcaaccagaagggtggcgtcggaaagtcgacatcgacgtttcatctggcccgtgccgcggtgttgcgtggccagcgtgtgcttgtcgtcgacaacgacccccagggcaacctgacgtctgtcgcggccgccgagcccgtgggggaggatcaggcggggctggccgatgtgctcagcgcgcgtgctccagagaccctccgcgatgtgatcgtgccgggaatctggtctggcctcgatgtcgtgccgacgtctggcatcacgctcggctgggtgcgtgacgaactcgtgatcgccggtgccggccgagaaggccggctgcgggaggccctggccggcgtcgaggacgactacgacgtgatcctgatcgactgtgctccatcgctcgatcagctcacgatcaacggcctggtggccgcccagggtgtcatcgtcgtgacgcactcgaagttgtggagcgccaacggcctcgcccagctgctcgacaccatcgacagcgtgcgcagctactacaacggcgcgctgcgcgtggcgggcatcatcgtcaaccagcacgaggagaacaccatcagcgggaaaacctggctcgacgagctgcatcaggctgccgagtcccggaagctgaccgtgcttgacccgccgatccccaagcgtgtcgtcatcgccgataccgtcgaggccgcgcgc

SEQ ID NO: 128 - DNA, 2557 bp, Propionibacterium acnes
aaacctctaccaagcatacgctggcaagcccccctctcggccccaccacaacatcaattgctgactcgaacacctttgaggcagcgctttcggcttgcgcaaccccacccacgacaccgtccgcttactactcgaagctgagggattcagaccccacctacaccctcgattgtgaagagcctccaaagcccgatacaacgtctggcgagacaccgtgaacgacctcgccaccgcagcaacgcaccagcagcgcgggatggcttggtattagcccagcgcagggcccccaggcaccagccctaacgaccccgcacccgacgtggctagaggataagccgcacgggaggactccatacccgccgactcattccagcccgccaccagccgagccatatgatcaaccgcccgcggtaaataatccagccactcacgccggtcgtacaaggaaccggccccgctccaggcgtgtgcccaggatcgccacaacacgtcgagctcgaccaccacgcccggaatagattcccactccaaatccggatcagcggccgccacgtaccagatcggccacatccgtcttggcccatctccagcccgccagacccagggaggccatcacctcatcgacgccgcgccgggtggtctcatcaaccccgtcaaacagctcgggccacctcgatgatgccgtccgtgaacgatccagattcatgacatgctcctcttcacagatgccgacgacgatcaggccgtggccgtggcaacggggtgacctgccggcgcggctcacgacgttgagccggaaccacacgagacgcaccagtgtgctgcgccgtcttgagtcgggcgctgtactgggccctggcgctgtggtgaacagcccgacgaagcaccgaccgccggctgtcctcatcgccagggcgaggcatggggcgcggcatggtgcgcccggtagcagcatccatgagggtgatccggtcagccaaaatgccgagccggttttcccacttccggggccacggcaccagcaggtcacgctgacagcccacgccgtggcgtcggcagtccacaacattttctcacggccaggatgcgagtgcagcagctccaccggaacaccagcatcacgcacccgccgcatcgtgacctcatcctcacgctgccgatcaccgtcaaccagatggtcagccacgatggtgttcacaccccatgactcatgcagttgcctggccaaggcgcccaacacctgctgacgcacctgtgacttgacgtcatcatcctccagatcctgtgtaccaaccatcacggaggccaacacatcactgcgttgctgaaccagggtgttgacgacgtcgacatcgtcgatacccatgggattgttggcgcgcgcggccacggcatgaaacgtgttggactgcaaattctcgaccagaccacgccgatagtcgttgaactgggaggtgtcggcaatgacaccggtcatgatgtaggccgacccctcggacaaggccctgtaggactcgtcgacgaacgccaccaaccccggccgccgccggtaaagtcgacctgcttcctcgtcagccagcaaccatgacagtttttgccccatatgtcctccttgctgacatgacctcgaacatggtaaactttccgtaggaaaaacggggcaagtactttcgagcggctacctcggcccccggtgggctgtccagccttgtgcggaccgaagccgggggattccttatgtttgcggcaatgatgccgctgcaccccctcatgccgtggtgtggtcctttccccgtgtgcggtgtggtgcgtcgttgactggtttgtggccccgagccttactctgaccggtaggagaacggtgtggggtctacggatagcccactcggctcccggtggaatgtccaacagggtagggttgatgagttggtccatcaggaccgtcccggtggctgcgtcaatgatcgatatttcgatgatgcgcccgtccaggtcggtggtttcggtgtcgaggatgactccgactccgggttctaggagttggggatccaatgggtggtcatcgtgtggctcctacagggagtgtctgggctggacagcggtgcaatacccgcgccatagcggttttttctgcgggggtgacccacagctggtatttcgttttgacggcgatttggcgggccacgtagtcgcatctgtaggccttgttagggggtagccaggtcgctgcatccctgtctcgtttggcctcattagcgggtccgtcgacagccagcaagttcaacgggtcgttggccagggcggtgcgttgcagcggtgagagtttttgcgcgccggtaatccacgcgttcccgagggctacgacgtggtcgatttggactgttgtcgaggtgtgccggccgcgccgccaggcgagtgtggacccggtgtaggggtcgtggagtcgcccggagacgaccacgcatcgtgatccgggtttcaggtgggcctcgaccaggtcgcgggcaagggcatcgttgcgggtgtcgcatccgttgtggccccaggggcgggtcaa

SEQ ID NO: 129 - DNA, 599 bp, Propionibacterium acnes; identical to SEQ ID NO: 100

SEQ ID NO: 130 - DNA, 1871 bp, Propionibacterium acnes
gccgacggttctcaagaactcgccggcggcctgcatcgccactcgaactgtaaccgtggtccgaccccgtgcacaggtaagctccacactcccaccaggcatggccgaggcagtaccaagttgccgtggcccatcggcagatttggttaaattttgaaaagtcatatagactccttctgtaaatttttaaatctcataggactctcgccatcgccagccagcttcgacaggagtcccgatgtttcaccgagtgaaatatcggcaccgtttgagttgacctaaagctcaaaagatgctagaatccatcttacctcgttaggggcgttttgtcaaacgcccctatattgcgtgtcttcgcgcgtcgtagcgctgatgctgcgcctgtgtcgactatccgtttgtaagtactttcgatgacaccagcagtggctactcatgactggtgcgtgcgggtctaaagcagcagggaaaggaatcgcagtagaagccgcttgattcctatcacccctgatggtactatcagtactaacagagcagggcttactcgatgcgtgagaatcggggacatgctgagcctctcgtaggtcattggcctgctgggcgtcagtgtggcgcggttcgatccagtgaactctatcagctctgttagtactgtcagagttgatatattcgaccccaggaggagcccatgagttacatcgttcgcaccggaaatttggtcgacacccccgagctgcgtgagggagagcatggcccgtacacctacgctcgcgtcatcgtgtccgatcgcattcgccaggaggacggcagctacgtcaacgggccagcgatcgcctacgacgtcttggcgggtggcagccaagccgtgaatctggttgaagccgccaaggcgagcggcaacatccgcatcatgttcgcgggccgttaccgcgtcaccgagtggcggggggagcagggcactcgtatccagcatgaggtccgagccgacgaagtgagcgtgagcctgctcggtcagagggtgaccgtggagcggcctcgaggtgacgtggcatccaaggagagcacgtcgttctgattgagtccgggggcacggtggtcgccgtggtaaaccgtgcccctgacagtactattgacactattggaggtatcagtgtgactgctcaaattttcgccttgtgcaaccagaagggtggcgtcggaaagtcgacatcgacgtttcatctggcccgtgccgcggtgttgcgtggccagcgtgtgcttgtcgtcgacaacgacccccagggcaacctgacgtctgtcgcggccgccgagcccgtgggggaggatcaggcggggctggccgatgtgctcagcgcgcgtgctccagagaccctccgcgatgtgatcgtgccgggaatctggtctggcctcgatgtcgtgccgacgtctggcatcacgctcggctgggtgcgtgacgaactcgtgatcgccggtgccggccgagaaggccggctgcgggaggccctggccggcgtcgaggacgactacgacgtgatcctgatcgactgtgctccatcgctcgatcagctcacgatcaacggcctggtggccgcccagggtgtcatcgtcgtgacgcactcgaagttgtggagcgccaacggcctcgcccagctgctcgacaccatcgacagcgtgcgcagctactacaacggcgcgctgcgcgtggcgggcatcatcgtcaaccagcacgaggagaacaccatcagcgggaaaacctggctcgacgagctgcatcaggctgccgagtcccggaagctgaccgtgcttgacccgccgatccccaagcgtgtcgtcatcgccgataccgtcgaggccgcgcgcggtctcgacga

SEQ ID NO: 131 - DNA, 1729 bp, Propionibacterium acnes
cacgcacccgccgcatcgtgacctcatcctcacgtgccaccagcgggggagagcgactaccgctgcagccggtccaaagcgactcttcacagatgagggggtggatcggtagctgacccctaggtcctgatgtgggtcgaggtccttggaatgatggaagttcctacacacccatcgccaaagacctcaacatggacaacgctaccttcaccactccctcatccgtgaagagccagtttatgcacggtgttgaaagaggcgtcggtctacgacgaatgcgggttaatggtcttgcggtgtggggcgctgggcgatggcatcgagaacgcgtgagtgggtggcgatccattcggccgcgtcggggttgatgttgcgggcgacggtgtcgatcgctgttacgtagtgggcaagcctgcgaatctcagcttgttggtcagggtgatcgctgatgagaggctcttgatgggaggcgcggttacggacgtggcggatgagctccacgttttcctcgaagtcgcgtcggctacgccccgggtagtgaggcatacctccgttacgtaagtcagtgagagctttccatacggttgcttccaggcgcggggtgagcagaaagcgccagttgtccagtgacagactcgccacgatctgatcaggggtcgcatcgagcctcgcgcgccgcagtcgcttctcggccctggcgacgttacgcgggaaaccaccgagccgatagctcggggattcccaccaacgccgtatgccagtatcggcgctcaggcgcacgtcaatgaagtttctcaggagtacctcgacatggctgatgtcttccaagaacgctttcgagatgcgggtgttccacacgtaccacgcatcgactggttcgatccggtagcggctgagcctggcgggtgagaaccactcctgcaacgtctcacgactcaccgtgggagcgtggtaggattgatgacgataggcctcgggaaggtcaatgccgcgaaatatcggtatacccccgaggccattgtcttgcccaggcccctcctcgcatacttgcggggcgtcattggctgccgtcatctcgtctcttcccggtacgtggctgtccatgttcacgggcaggtacggcaatgaggttcccgcacacaaacctctaccaagcatacgctggcaagcccccctctcggccccaccacaacatcaattgctgactcgaacacctttgaggcagcgctttcggcttgcgcaaccccacccacgacaccgtccgcttactactcgaagctgagggattcagaccccacctacaccctcgattgtgaagagcctccaaagcccgatacaacgtctggcgagacaccgtgaacgacctcgccaccgcagcaacgcaccagcagcgcgggatggcttggtattagcccagcgcagggcccccaggcaccagccctaacgaccccgcacccgacgtggctagaggataagccgcacgggaggactccatacccgccgactcattccagcccgccaccagccgagccatatgatcaaccgcccgcggtaaataatccagccactcacgccggtcgtacaaggaaccggccccgctccaggcgtgtgcccaggatcgccacaacacgtcgagctcgaccaccacgcccggaatagattcccactccaaatccggatcagcggccgccacgtaccagatcggccacatccgtcttggcccatctcc

SEQ ID NO: 132 - DNA, 1729 bp, Propionibacterium acnes; identical to SEQ ID NO: 131

SEQ ID NO: 133 - DNA, 1725 bp, Propionibacterium acnes
cgcacccgccgcatcgtgacctcatcctcacgtgccaccagcgggggagagcgactaccgctgcagccggtccaaagcgactcttcacagatgagggggtggatcggtagctgacccctaggtcctgatgtgggtcgaggtccttggaatgatggaagttcctacacacccatcgccaaagacctcaacatggacaacgctaccttcaccactccctcatccgtgaagagccagtttatgcacggtgttgaaagaggcgtcggtctacgacgaatgcgggttaatggtcttgcggtgtggggcgctgggcgatggcatcgagaacgcgtgagtgggtggcgatccattcggccgcgtcggggttgatgttgcgggcgacggtgtcgatcgctgttacgtagtgggcaagcctgcgaatctcagcttgttggtcagggtgatcgctgatgagaggctcttgatgggaggcgcggttacggacgtggcggatgagctccacgttttcctcgaagtcgcgtcggctacgccccgggtagtgaggcatacctccgttacgtaagtcagtgagagctttccatacggttgcttccaggcgcggggtgagcagaaagcgccagttgtccagtgacagactcgccacgatctgatcaggggtcgcatcgagcctcgcgcgccgcagtcgcttctcggccctggcgacgttacgcgggaaaccaccgagccgatagctcggggattcccaccaacgccgtatgccagtatcggcgctcaggcgcacgtcaatgaagtttctcaggagtacctcgacatggctgatgtcttccaagaacgctttcgagatgcgggtgttccacacgtaccacgcatcgactggttcgatccggtagcggctgagcctggcgggtgagaaccactcctgcaacgtctcacgactcaccgtgggagcgtggtaggattgatgacgataggcctcgggaaggtcaatgccgcgaaatatcggtatacccccgaggccattgtcttgcccaggcccctcctcgcatacttgcggggcgtcattggctgccgtcatctcgtctcttcccggtacgtggctgtccatgttcacgggcaggtacggcaatgaggttcccgcacacaaacctctaccaagcatacgctggcaagcccccctctcggccccaccacaacatcaattgctgactcgaacacctttgaggcagcgctttcggcttgcgcaaccccacccacgacaccgtccgcttactactcgaagctgagggattcagaccccacctacaccctcgattgtgaagagcctccaaagcccgatacaacgtctggcgagacaccgtgaacgacctcgccaccgcagcaacgcaccagcagcgcgggatggcttggtattagcccagcgcagggcccccaggcaccagccctaacgaccccgcacccgacgtggctagaggataagccgcacgggaggactccatacccgccgactcattccagcccgccaccagccgagccatatgatcaaccgcccgcggtaaataatccagccactcacgccggtcgtacaaggaaccggccccgctccaggcgtgtgcccaggatcgccacaacacgtcgagctcgaccaccacgcccggaatagattcccactccaaatccggatcagcggccgccacgtaccagatcggccacatccgtcttggcccatct

SEQ ID NO: 134 - DNA, 1719 bp, Propionibacterium acnes
cccgccgcatcgtgacctcatcctcacgtgccaccagcgggggagagcgactaccgctgcagccggtccaaagcgactcttcacagatgagggggtggatcggtagctgacccctaggtcctgatgtgggtcgaggtccttggaatgatggaagttcctacacacccatcgccaaagacctcaacatggacaacgctaccttcaccactccctcatccgtgaagagccagtttatgcacggtgttgaaagaggcgtcggtctacgacgaatgcgggttaatggtcttgcggtgtggggcgctgggcgatggcatcgagaacgcgtgagtgggtggcgatccattcggccgcgtcggggttgatgttgcgggcgacggtgtcgatcgctgttacgtagtgggcaagcctgcgaatctcagcttgttggtcagggtgatcgctgatgagaggctcttgatgggaggcgcggttacggacgtggcggatgagctccacgttttcctcgaagtcgcgtcggctacgccccgggtagtgaggcatacctccgttacgtaagtcagtgagagctttccatacggttgcttccaggcgcggggtgagcagaaagcgccagttgtccagtgacagactcgccacgatctgatcaggggtcgcatcgagcctcgcgcgccgcagtcgcttctcggccctggcgacgttacgcgggaaaccaccgagccgatagctcggggattcccaccaacgccgtatgccagtatcggcgctcaggcgcacgtcaatgaagtttctcaggagtacctcgacatggctgatgtcttccaagaacgctttcgagatgcgggtgttccacacgtaccacgcatcgactggttcgatccggtagcggctgagcctggcgggtgagaaccactcctgcaacgtctcacgactcaccgtgggagcgtggtaggattgatgacgataggcctcgggaaggtcaatgccgcgaaatatcggtatacccccgaggccattgttttgcccaggcccctcctcgcatacttgcggggcgtcattggctgccgtcatctcgtctcttcccggtacgtggctgtccatgttcacgggcaggtacggcaatgaggttcccgcacacaaacctctaccaagcatacgctggcaagcccccctctcggccccaccacaacatcaattgctgactcgaacacctttgaggcagcgctttcggcttgcgcaaccccacccacgacaccgtccgcttactactcgaagctgagggattcagaccccacctacaccctcgattgtgaagagcctccaaagcccgatacaacgtctggcgagacaccgtgaacgacctcgccaccgcagcaacgcaccagcagcgcgggatggcttggtattagcccagcgcagggcccccaggcaccagccctaacgaccccgcacccgacgtggctagaggataagccgcacgggaggactccatacccgccgactcattccagcccgccaccagccgagccatatgatcaaccgcccgcggtaaataatccagccactcacgccggtcgtacaaggaaccggccccgctccaggcgtgtgcccaggatcgccacaacacgtcgagctcgaccaccacgcccggaatagattcccactccaaatccggatcagcggccgccacgtaccagatcggccacatccgtcttggcccat

SEQ ID NO: 135 - DNA, 1656 bp, Propionibacterium acnes
accagcgggggagagcgactaccgctgcagccggtccaaagcgactcttcacagatgagggggtggatcggtagctgacccctaggtcctgatgtgggtcgaggtccttggaatgatggaagttcctacacacccatcgccaaagacctcaacatggacaacgctaccttcaccactccctcatctgtgaagagccagtttatgcacggtgttgaaagaggcgtcggtctacgacgaatgcgggttaatggtcttgcggtgtggggcgctgggcgatggcatcgagaacgcgtgagtgggtggcgatccattcggccgcgtcggggttgatgttgcgggcgacggtgtcgatcgctgttacgtagtgggcaagcctgcgaatctcagcttgttggtcagggtgagcgctgatgaggggctcttgatgggaggcgcggttacggacgtggcggatgagctccacgttttcctcgaagtcgcgtcggctacgccccgggtagtgaggcatacctccgttacgtaagtcagtgagagctttccatacggttgcttccaggcgcggggtgagcagaaagcgccagttgtccagtgacagactcgccacgatctgatcaggggtcgcatcgagcctcgcgcgccgcagtcgcttctcggccctgtcgacgttacgcgggaaaccaccgagccgatagctcggggattcccaccaacgccgtatgccagtatcggcgctcaggcgcacgtcaatgaagtttctcaggagtacctcgacatggctgatgtcttccaagaacgctttcgagatgcgggtgttccacacgtaccacgcatcgactggttcgatccggtagcggctgagcctggcgggtgagaaccactcctgcaacgtctcacgactcaccgtgggagcgtggtaggattgatgacgataggcctcgggaaggtcaatgccgcgaaatatcggtatacccccgaggccattgttttgcccaggcccctcctcgcatacttgcggggcgtcattggctgccgtcatctcgtctcttcccggtacgtggctgtccatgttcacgggcaggtacggcaatgaggttcccgcacacaaacctctaccaagcatacgctggcaagcccccctctcggccccaccacaacatcaattgctgactcgaacacctttgaggcagcgctttcggcttgcgcaaccccatccacgacaccgtccgcttactactcgaagctgagggattcagaccccacctacaccctcgattgtgaagagcctccaaagcccgatacaacgtctggcgagacaccgtgaacgacctcgccaccgcagcaacgcaccagcagcgcgggatggcttggtattagcccagcgcagggccccaggcaccagccctaacgaccccgcacccgacgtggctagaggataagccgcacgggaggactccatacccgccgactcattccagcccgccaccagccgagccatatgatcaaccgcccgcggtaaataatccagccactcacgccggtcgtataaggaaccggccccgctccaggcgtgtgcccaggatcgccacaacacgtcgagctcgaccaccacgcccggaatagattcccactccaaatccggatcagcggccgccacgt

SEQ ID NO: 136 - DNA, 1438 bp, Propionibacterium acnes
cacgcacccgccgcatcgtgacctcatcctcacgctgccgatcaccgtcaaccagatggtcagccacgatggtgttcacaccccatgactcatgcagttgcctggccaaggcgcccaacacctgctgacgcacctgtgacttgacgtcatcatcctccagatcctgtgtaccaaccatcacggaggccaacacatcactgcgttgctgaaccagggtgttgacgacgtcgacatcgtcgatacccatgggattgttggcgcgcgcggccacggcatgaaacgtgttggactgcaaattctcgaccagaccacgccgatagtcgttgaactgggaggtgtcggcaatgacaccggtcatgatgtaggccgacccctcggacaaggccctgtaggactcgtcgacgaacgccaccaaccccggccgccgccggtaaagtcgacctgcttcctcgtcagccagcaaccatgacagtttttgccccatatgtcctccttgctgacatgacctcgaacatggtaaactttccgtaggaaaaacggggcaagtactttcgagcggctacctcggcccccggtgggctgtccagccttgtgcggaccgaagccgggggattccttatgtttgcggcaatgatgccgctgcaccccctcatgccgtggtgtggtcctttccccgtgtgcggtgtggtgcgtcgttgactggtttgtggccccgagccttactctgaccggtaggagaacggtgtggggtctacggatagcccactcggctcccggtggaatgtccaacagggtagggttgatgagttggtccatcaggaccgtcccggtggctgcgtcaatgatcgatatttcgatgatgcgcccgtccaggtcggtggtttcggtgtcgaggatgactccgactccgggttctaggagttggggatccaatgggtggtcatcgtgtggctcctacagggagtgtctgggctggacagcggtgcaatacccgcgccatagcggttttttctgcgggggtgacccacagctggtatttcgttttgacggcgatttggcgggccacgtagtcgcatctgtaggccttgttagggggtagccaggtcgctgcatccctgtctcgtttggcctcattagcgggtccgtcgacagccagcaagttcaacgggtcgttggccagggcggtgcgttgcagcggtgagagtttttgcgcgccggtaatccacgcgttcccgagggctacgacgtggtcgatttggactgttgtcgaggtgtgccggccgcgccgccaggcgagtgtggacccggtgtaggggtcgtggagtcgcccggagacgaccacgcatcgtgatccgggtttcaggtgggcctcgaccaggtcgcgggcaagggcatcgttgcgggtgtcgcatccgttgtggccccaggggcgggtcaa

SEQ ID NO: 137 - DNA, 1436 bp, Propionibacterium acnes
cgcacccgccgcatcgtgacctcatcctcacgctgccgatcaccgtcaaccagatggtcagccacgatggtgttcacaccccatgactcatgcagttgcctggccaaggcgcccaacacctgctgacgcacctgtgacttgacgtcatcatcctccagatcctgtgtaccaaccatcacggaggccaacacatcactgcgttgctgaaccagggtgttgacgacgtcgacatcgtcgatacccatgggattgttggcgcgcgcggccacggcatgaaacgtgttggactgcaaattctcgaccagaccacgccgatagtcgttgaactgggaggtgtcggcaatgacaccggtcatgatgtaggccgacccctcggacaaggccctgtaggactcgtcgacgaacgccaccaaccccggccgccgccggtaaagtcgacctgcttcctcgtcagccagcaaccatgacagtttttgccccatatgtcctccttgctgacatgacctcgaacatggtaaactttccgtaggaaaaacggggcaagtactttcgagcggctacctcggcccccggtgggctgtccagccttgtgcggaccgaagccgggggattccttatgtttgcggcaatgatgccgctgcaccccctcatgccgtggtgtggtcctttccccgtgtgcggtgtggtgcgtcgttgactggtttgtggccccgagccttactctgaccggtaggagaacggtgtggggtctacggatagcccactcggctcccggtggaatgtccaacagggtagggttgatgagttggtccatcaggaccgtcccggtggctgcgtcaatgatcgatatttcgatgatgcgcccgtccaggtcggtggtttcggtgtcgaggatgactccgactccgggttctaggagttggggatccaatgggtggtcatcgtgtggctcctacagggagtgtctgggctggacagcggtgcaatacccgcgccatagcggttttttctgcgggggtgacccacagctggtatttcgttttgacggcgatttggcgggccacgtagtcgcatctgtaggccttgttagggggtagccaggtcgctgcatccctgtctcgtttggcctcattagcgggtccgtcgacagccagcaagttcaacgggtcgttggccagggcggtgcgttgcagcggtgagagtttttgcgcgccggtaatccacgcgttcccgagggctacgacgtggtcgatttggactgttgtcgaggtgtgccggccgcgccgccaggcgagtgtggacccggtgtaggggtcgtggagtcgcccggagacgaccacgcatcgtgatccgggtttcaggtgggcctcgaccaggtcgcgggcaagggcatcgttgcgggtgtcgcatccgttgtggccccaggggcgggtcaa

SEQ ID NO: 138 - DNA, 1436 bp, Propionibacterium acnes; identical to SEQ ID NO: 137

SEQ ID NO: 139 - DNA, 1432 bp, Propionibacterium acnes
cccgccgcatcgtgacctcatcctcacgctgccgatcaccgtcaaccagatggtcagccacgatggtgttcacaccccatgactcatgcagttgcctggccaaggcgcccaacacctgctgacgcacctgtgacttgacgtcatcatcctccagatcctgtgtaccaaccatcacggaggccaacacatcactgcgttgctgaaccagggtgttgacgacgtcgacatcgtcgatacccatgggattgttggcgcgcgcggccacggcatgaaacgtgttggactgcaaattctcgaccagaccacgccgatagtcgttgaactgggaggtgtcggcaatgacaccggtcatgatgtaggccgacccctcggacaaggccctgtaggactcgtcgacgaacgccaccaaccccggccgccgccggtaaagtcgacctgcttcctcgtcagccagcaaccatgacagtttttgccccatatgtcctccttgctgacatgacctcgaacatggtaaactttccgtaggaaaaacggggcaagtactttcgagcggctacctcggcccccggtgggctgtccagccttgtgcggaccgaagccgggggattccttatgtttgcggcaatgatgccgctgcaccccctcatgccgtggtgtggtcctttccccgtgtgcggtgtggtgcgtcgttgactggtttgtggccccgagccttactctgaccggtaggagaacggtgtggggtctacggatagcccactcggctcccggtggaatgtccaacagggtagggttgatgagttggtccatcaggaccgtcccggtggctgcgtcaatgatcgatatttcgatgatgcgcccgtccaggtcggtggtttcggtgtcgaggatgactccgactccgggttctaggagttggggatccaatgggtggtcatcgtgtggctcctacagggagtgtctgggctggacagcggtgcaatacccgcgccatagcggttttttctgcgggggtgacccacagctggtatttcgttttgacggcgatttggcgggccacgtagtcgcatctgtaggccttgttagggggtagccaggtcgctgcatccctgtctcgtttggcctcattagcgggtccgtcgacagccagcaagttcaacgggtcgttggccagggcggtgcgttgcagcggtgagagtttttgcgcgccggtaatccacgcgttcccgagggctacgacgtggtcgatttggactgttgtcgaggtgtgccggccgcgccgccaggcgagtgtggacccggtgtaggggtcgtggagtcgcccggagacgaccacgcatcgtgatccgggtttcaggtgggcctcgaccaggtcgcgggcaagggcatcgttgcgggtgtcgcatccgttgtggccccaggggcgggtcaa

SEQ ID NO: 140 - DNA, 1432 bp, Propionibacterium acnes
cccgccgcatcgtgacctcatcctcacgctgccgatcaccgtcaaccagatggtcagccacgatggtgttcacaccccatgactcatgcagttgcctggccaaggcgcccaacacctgctgacgcacctgtgacttgacgtcatcatcctccagatcctgtgtaccaaccatcacggaggccaacacatcactgcgttgctgaaccagggtgttgacgacgtcgacatcgtcgatatccatgggattgttggcgcgcgcggccacggcatgaaacgtgttggactgcaaattctcgaccagaccacgccgatagtcgttgaactgggaggtgtcggcaatgacaccggtcatgatgtaggccgacccctcggacaaggccctgtaggactcgtcgacgaacgccaccaaccccggccgccgccggtaaagtcgacctgcttcctcgtcagccagcaaccatgacagtttttgccccatatgtcctccttgctgacatgacctcgaacatggtaaactttccgtaggaaaaacggggcaagtactttcgagcggctacctcggcccccggtgggctgtccagccttgtgcggaccgaagccgggggattccttatgtttgcggcaatgatgccgctgcaccccctcatgccgtggtgtggtcctttccccgtgtgcggtgtggtgcgtcgttgactggtttgtggccccgagccttactctgaccggtaggagaacggtgtggggtctacggatagcccactcggctcccggtggaatgtccaacagggtagggttgatgagttggtccatcaggaccgtcccggtggctgcgtcaatgatcgatatttcgatgatgcgcccgtccaggtcggtggtttcggtgtcgaggatgactccgactccgggttctaggagttggggatccaatgggtggtcatcgtgtggctcctacagggagtgtctgggctggacagcggtgcaatacccgcgccatagcggttttttctgcgggggtgacccacagctggtatttcgttttgacggcgatttggcgggccacgtagtcgcatctgtaggccttgttagggggtagccaggtcgctgcatccctgtctcgtttggcctcattagcgggtccgtcgacagccagcaagttcaacgggtcgttggccagggcggtgcgttgcagcggtgagagtttttgcgcgccggtaatccacgcgttcccgagggctacgacgtggtcgatttggactgttgtcgaggtgtgccggccgcgccgccaggcgagtgtggacccggtgtaggggtcgtggagtcgcccggagacgaccacgcatcgtgatccgggtttcgggtgggcctcgaccaggtcgcgggcaagggcatcgttgcgggtgtcgcatccgttgtggccccaggggcgggtcaa

SEQ ID NO: 141 - DNA, 1438 bp, Propionibacterium acnes
cacgcacccgccgcatcgtgacctcatcctcacgctgccgatcaccgtcaaccagatggtcagccacgatggtgttcacaccccatgactcatgcagttgcctggccaaggcgcccaacacctgctgacgcacctgtgacttgacgtcatcatcctccagatcctgtgtaccaaccatcacggaggccaacacatcactgcgttgctgaaccagggtgttgacgacgtcgacatcgtcgatacccatgggattgttggcgcgcgcggccacggcatgaaacgtgttggactgcaaattctcgaccagaccacgccgatagtcgttgaactgggaggtgtcggcaatgacaccggtcatgatgtaggccgacccctcggacaaggccctgtaggactcgtcgacgaacgccaccaaccccggccgccgccggtaaagtcgacctgcttcctcgtcagccagcaaccatgacagtttttgccccatatgtcctccttgctgacatgacctcgaacatggtaaactttccgtaggaaaaacggggcaagtactttcgagcggctacctcggcccccggtgggctgtccagccttgtgcggaccgaagccgggggattccttatgtttgcggcaatgatgccgcttcattttttcttgccgtggtgtggtcctttccccgtgtgcggtgtggtgcgtcgttgactggtttgtggccccgagccttactctgaccggtaggagaacggtgtggggtctacggatagcccactcggctcccggtggaatgtccaacagggtagggttgatgagttggtccatcaggaccgtcccggtggctgcgtcaatgatcgatatttcgatgatgcgcccgtccaggtcggtggtttcggtgtcgaggatgactccgactccgggttctaggagttggggatccaatgggtggtcatcgtgtggctcctacagggagtgtctgggctggacagcggtgcaatacccgcgccatagcggttttttctgcgggggtgacccacagctggtatttcgttttgacggcgatttggcgggccacgtagtcgcatctgtaggccttgttagggggtagccaggtcgctgcatccctgtctcgtttggcctcattagcgggtccgtcgacagccagcaagttcaacgggtcgttggccagggcggtgcgttgcagcggtgagagtttttgcgcgccggtaatccacgcgttcccgagggctacgacgtggtcgatttggactgttgtcgaggtgtgccggccgcgccgccaggcgagtgtggacccggtgtaggggtcgtggagtcgcccggagacgaccacgcatcgtgatccgggtttcaggtgggcctcgaccaggtcgcgggcaagggcatcgttgcgggtgtcgcatccgttgtggccccaggggcgggtcaa

SEQ ID NO: 142 - DNA, 1399 bp, Propionibacterium acnes
gatcaccgtcaaccagatggtcagccacgatggtgttcacaccccatgactcatgcagttgcctggccaaggcgcccaacacctgctgacgcacctgtgacttgacgtcatcatcctccagatcctgtgtaccaaccatcacggaggccaacacatcactgcgttgctgaaccagggtgttgacgacgtcgacatcgtcgatacccatgggattgttggcgcgcgcggccacggcatgaaacgtgttggactgcaaattctcgaccagaccacgccgatagtcgttgaactgggaggtgtcggcaatgacaccggtcatgatgtaggccgacccctcggacaaggccctgtaggactcgtcgacgaacgccaccaaccccggccgccgccggtaaagtcgacctgcttcctcgtcagccagcaaccatgacagtttttgccccatatgtcctccttgctgacatgacctcgaacatggtaaactttccgtaggaaaaacggggcaagtactttcgagcggctacctcggcccccggtggaatgtccagccttgtgcggaccgaagccgggggattccttatgtttgcggcaatgatgccgctgcaccccctcatgccgtggtgtggtcctttccccgtgtgcggtgtggtgcgtcgttgactggtttgtggccccgagccttactctgaccggtaggagaacggtgtggggtctacggatagcccactcggctcccggtggaatgtccaacagggtagggttgatgagttggtccatcaggaccgtcccggtggctgcgtcaatgatcgatatttcgatgatgcgcccgtccaggtcggtggtttcggtgtcgaggatgactccgactccgggttctaggagttggggatccaatgggtggtcatcgtgtggctcctacagggagtgtctgggctggacagcggtgcaatacccgcgccatagcggttttttctgcgggggtgacccacagctggtatttcgttttgacggcgatttggcgggccacgtagtcgcatctgtaggccttgttagggggtagccaggtcgctgcatccctgtctcgtttggcctcattagcgggtccgtcgacagccagcaagttcaacgggtcgttggccagggcggtgcgttgcagcggtgagagtttttgcgcgccggtaatccacgcgttcccgagggctacgacgtggtcgatttggactgttgtcgaggtgtgccggccgcgccgccaggcgagtgtggacccggtgtaggggtcgtggagtcgcccggagacgaccacgcatcgtgatccgggtttcaggtgggcctcgaccaggtcgcgggcaagggcatcgttgcgggtgtcgcatccgttgtggccccaggggcgggtcaa

SEQ ID NO: 143 - DNA, 1155 bp, Propionibacterium acnes
acaaacctctaccaagcatacgctggcaagcccccctctcggccccaccacaacatcaattgctgactcgaacacctttgaggcagcgctttcggcttgcgcaaccccacccacgacaccgtccgcttactactcgaagctgagggattcagaccccacctacaccctcgattgtgaagagcctccaaagcccgatacaacgtctggcgagacaccgtgaacgacctcgccaccgcagcaacgcaccagcagcgcgggatggcttggtattagcccagcgcagggcccccaggcaccagccctaacgaccccgcacccgacgtggctagaggataagccgcacgggaggactccatacccgccgactcattccagcccgccaccagccgagccatatgatcaaccgcccgcggtaaataatccagccactcacgccggtcgtacaaggaaccggccccgctccaggcgtgtgcccaggatcgccacaacacgtcgagctcgaccaccacgcccggaatagattcccactccaaatccggatcagcggccgccacgtaccagatcggccacatccgtcttggcccatctccagcccgccagacccagggaggccatcacctcatcgacgccgcgccgggtggtctcatcaaccccgtcaaacagctcgggccacctcgatgatgccgtccgtgaacgatccagattcatgacatgctcctcttcacagatgccgacgacgatcaggccgtggccgtggcaacggggtgacctgccggcgcggctcacgacgttgagccggaaccacacgagacgcaccagtgtgctgcgccgtcttgagtcgggcgctgtactgggccctggcgctgtggtgaacagcccgacgaagcaccgaccgccggctgtcctcatcgccagggcgaggcatggggcgcggcatggtgcgcccggtagcagcatccatgagggtgatccggtcagccaaaatgccgagccggttttcccacttccggggccacggcaccagcaggtcacgctgacagcccacgccgtggcgtcggcagtccacaacattttctcacggccaggatgcgagtgcagcagctccaccggaacaccagcatcacgcacccgccgcatcgtgacctcatcctcacg

SEQ ID NO: 144 - DNA, 715 bp, Propionibacterium acnes
accagatcggccacatccgtcttggcccatctccagcccgccagacccagggaggccatcacctcatcgacgccgcgccgggtggtctcatcaaccccgtcaaacagctcgggccacctcgatgatgccgtccgtgaacgatccagattcatgacatgctcctcttcacagatgccgacgacgatcaggccgtggccgtggcaacggggtgacctgccggcgcggctcacgacgttgagccggaaccacacgagacgcaccagtgtgctgcgccgtcttgagtcgggcgctgtactgggccctggcgctgtggtgaacagcccgacgaagcaccgaccgccggctgtcctcatcgccagggcgaggcatggggcgcggcatggtgcgcccggtagcagcatccatgagggtgatccggtcagccaaaatgccgagccggttttcccacttccggggccacggcaccagcaggtcacgctgacagcccacgccgtggcgtcggcagtccacaacattttctcacggccaggatgcgagtgcagcagctccaccggaacaccagcatcacgcacccgccgcatcgtgacctcatcctcacgtgccaccagcgggggagagcgactaccgctgcagccggtccaaagcgactcttcacagatgagggggtggatcggtagctgacccctaggtcctgatgtgggtcgaggtccttgga

SEQ ID NO: 145 - DNA, 1134 bp, Propionibacterium acnes
gtgttccagtgcctcgcgggcgtgatgttcttcttcggcaccttcttgccacatgcttcgcgcttcagcctcgccatccaagcgaacctggactgtgaacgagtcctcatcgggtccgtcctcattccacgcggcaatgatcccacgggcctcgtctgcgacctgactcaacttcatcgcctgcccgacagccccgagagccggaatctcgaacacccagatattcgcctcagccgagacctcacgatgggcgatcacttcgtaggtcgtctcaccttctactgtcgtgtccattacttccactccttcggaattttcacgcctgctcgctccagctgtgccaggacaccaactgacgtcagctggtgtcctgctggtatcgatacgcgcccggctccgccggggcgtccccagatttcatggcttcccttggcgttccgcagacgggcccatccttgagaacggagcagcttgaggacgtccttagttttctgcggtttcacacatcatagtatagccccacttaacttgtaaactaagcccctgtttacattttagttggtgcatgtgatccctgctcttatgacgtcgcccgacctggcgccttagacatgcactgttcatcctcaaccacactcaccgtcacgggtccgaaggcgaggtctatcaccattcgcatcgatgaagttgaagcaggatcgtccgcatcacgcactgccgatccggacagacgccaccggccgtaccgactgtttacgatctgccaccgcagactgctgccataaccgctatcacctctgatagtacgtttagtactatcagaggtgattcaagattctcctgtcgagcagccctacagtcacgaagtcctgcgatcgtcatcgcttaaggcagacggatggccatcggggaccactcgcaaagcaggggcgatcagcaacagtgatgtgccatgagcaagtactggtgcaccggctgtttactccgcccctagataaaccacgggtgcaggggtggacaccacaccatgaccgatgtggtgcccaccccatggctcacaggcaggccctatcgccgggagcactgctgcagatgaggctcagtaacctgccatgtctcacctggggccaaggt

SEQ ID NO: 146 - DNA, 1057 bp, Propionibacterium acnes
cccctaggtcctgatgtgggtcgaggtccttggaatgatggaagttcctacacacccatcgccaaagacctcaacatggacaacgctaccttcaccactccctcatctgtgaagagccagtttatgcacggtgttgaaagaggcgtcggtctacgacgaatgcgggttaatggtcttgcggtgtggggcgctgggcgatggcatcgagaacgcgtgagtgggtggcgatccattcggccgcgtcggggttgatgttgcgggcgacggtgtcgatcgctgttacgtagtgggcaagcctgcgaatctcagcttgttggtcagggtgatcgctgatgagaggctcttgatgggaggcgcggttacggacgtggcggatgagctccacgttttcctcgaagtcgcgtcggctacgccccgggtagtgaggcatacctccgttacgtaagtcagtgagagctttccatacggttgcttccaggcgcggggtgagcagaaagcgccagttgtccagtgacagactcgccacgatctgatcaggggtcgcatcgagcctcgcgcgccgcagtcgcttctcggccctggcgacgttacgcgggaaaccaccgagccgatagctcggggattcccaccaacgccgtatgccagtatcggcgctcaggcgcacgtcaatgaagtttctcaggagtacctcgacatggctgatgtcttccaagaacgctttcgagatgcgggtgttccacacgtaccacgcatcgactggttcgatccggtagcggctgagcctggcgggtgagaaccactcctgcaacgtctcacgactcaccgtgggagcgtggtaggattgatgacgataggcctcgggaaggtcaatgccgcgaaatatcggtatacccccgaggtcattgttttgcccaggcccctcctcgcatacttgcggggcgtcattggctgccgtcatctcgtctcttcccggtacgtggctgtccatgttcacgggcaggtacggcaatgaggttcccgcacacaaacctctaccaagcatacgctggcaagcccc

SEQ ID NO: 147 - DNA, 1057 bp, Propionibacterium acnes; identical to SEQ ID NO: 146

SEQ ID NO: 148 - DNA, 1057 bp, Propionibacterium acnes; identical to SEQ ID NO: 146

SEQ ID NO: 149 - DNA, 1055 bp, Propionibacterium acnes
cccctaggtcctgatgtgggtcgaggtccttggaatgatggaagttcctacacacccatcgccaaagacctcaacatggacaacgctaccttcaccactccctcatctgtgaagagccagtttatgcacggtgttgaaagaggcgtcggtctacgacgaatgcgggttaatggtcttgcggtgtggggcgctgggcgatggcatcgagaacgcgtgagtgggtggcgatccattcggccgcgtcggggttgatgttgcgggcgacggtgtcgatcgctgttacgtagtgggcaagcctgcgaatctcagcttgttggtcagggtgatcgctgatgaggggctcttgatgggaggcgcggttacggacgtggcggatgagctccacgttttcctcgaagtcgcgtcggctacgccccgggtagtgaggcatacctccgttacgtaagtcagtgagagctttccatacggttgcttccaggcgcggggtgagcagaaagcgccagttgtccagtgacagactcgccacgatctgatcaggggtcgcatcgagccccgcgcgccgcagtcgcttctcggccctggcgacgttacgcgggaaaccaccgagccgatagctcggggattcccaccaacgccgtatgccagtatcggcgctcaggcgcacgtcaatgaagtttctcaggagtacctcgacatggctgatgtcttccaagaacgctttcgagatgcgggtgttccacacgtaccacgcatcgactggttcgatccggtagcggctgagcctggcgggtgagaaccactcctgcaacgtctcacgactcaccgtgggagcgtggtaggattgatgacgataggcctcgggaaggtcaatgccgcgaaatatcggtatacccccgaggtcattgtcttgcccaggcccctcctcgcatacttgcggggcgtcattggctgccgtcatctcgtctcttcccggtacgtggctgtccatgttcacgggcaggtacggcaatgaggttcccgcacacaaacctctaccaagcatacgctggcaagcc

SEQ ID NO: 150 - DNA, 1055 bp, Propionibacterium acnes; identical to SEQ ID NO: 149

SEQ ID NO: 151 - DNA, 1055 bp, Propionibacterium acnes
cccctaggtcctgatgtgggtcgaggtccttggaatgatggaagttcctacacacccatcgccaaagacctcaacatggacaacgctaccttcaccactccctcatctgtgaagagccagtttatgcacggtgttgaaagaggcgtcggtctacgacgaatgcgggttaatggtcttgcggtgtggggcgctgggcgatggcatcgagaacgcgtgagtgggtggcgatccattcggccgcgtcggggttgatgttgcgggcgacggtgtcgatcgctgttacgtagtgggcaagcctgcgaatctcagcttgttggtcagggtgagcgctgatgaggggctcttgatgggaggcgcggttacggacgtggcggatgagctccacgttttcctcgaagtcgcgtcggctacgccccgggtagtgaggcatacctccgttacgtaagtcagtgagagctttccatacggttgcttccaggcgcggggtgagcagaaagcgccagttgtccagtgacagactcgccacgatctgatcaggggtcgcatcgagcctcgcgcgccgcagtcgcttctcggccctgtcgacgttacgcgggaaaccaccgagccgatagctcggggattcccaccaacgccgtatgccagtatcggcgctcaggcgcacgtcaatgaagtttctcaggagtacctcgacatggctgatgtcttccaagaacgctttcgagatgcgggtgttccacacgtaccacgcatcgactggttcgatccggtagcggctgagcctggcgggtgagaaccactcctgcaacgtctcacgactcaccgtgggagcgtggtaggattgatgacgataggcctcgggaaggtcaatgccgcgaaatatcggtatacccccgaggccattgttttgcccaggcccctcctcgcatacttgcggggcgtcattggctgccgtcatctcgtctcttcccggtacgtggctgtccatgttcacgggcaggtacggcaatgaggttcccgcacacaaacctctaccaagcatacgctggcaagcc

SEQ ID NO: 152 - DNA, 1055 bp, Propionibacterium acnes
cccctaggtcctgatgtgggtcgaggtccttggaatgatggaagttcctacacacccatcgccaaagacctcaacatggacaacgctaccttcaccactccctcatccgtgaagagccagtttatgcacggtgttgaaagaggcgtcggtctacgacgaatgcgggttaatggtcttgcggtgtggggcgctgggcgatggcatcgagaacgcgtgagtgggtggcgatccattcggccgcgtcggggttgatgttgcgggcgacggtgtcgatcgctgttacgtagtgggcaagcctgcgaatctcagcttgttggtcagggtgagcgctgatgaggggctcttgatgggaggcgcggttacggacgtggcggatgagctccacgttttcctcgaagtcgcgtcggctacgccccgggtagtgaggcatacctccgttacgtaagtcagtgagagctttccatacggttgcttccaggcgcggggtgagcagaaagcgccagttgtccagtgacagactcgccacgatctgatcaggggtcgcatcgagcctcgcgcgccgcagtcgcttctcggccctgtcgacgttacgcgggaaaccaccgagccgatagctcggggattcccaccaacgccgtatgccagtatcggcgctcaggcgcacgtcaatgaagtttctcaggagtacctcgacatggctgatgtcttccaagaacgctttcgagatgcgggtgttccacacgtaccacgcatcgactggttcgatccggtagcggctgagcctggcgggtgagaaccactcctgcaacgtctcacgactcaccgtgggagcgtggtaagattgatgacgataggcctcgggaaggtcaatgccgcgaaatatcggtatacccccgaggtcattgtcttgcccaggcccctcctcgcatacttgcggggcgtcattggctgccgtcatctcgtctcttcccggtacgtggctgtccatgttcacgggcaggtacggcaatgaggttcccgcacacaaacctctaccaagcatacgctggcaagcc

SEQ ID NO: 153 - DNA, 1057 bp, Propionibacterium acnes
cccctaggtcctgatgtgggtcgaggtccttggaatgatggaagttcctacacacccatcgccaaagacctcaacatggacaacgctaccttcaccactccctcatctgtgaagagccagtttatgcacggtgttgaaagaggcgtcggtctacgacgaatgcgggttaatggtcttgtggtgtggggcgctgggcgatggcatcgagaacgcgtgagtgggtggcgatccattcggccgcgtcggggttgatgttgcgggcgacggtgtcgatcgctgttacgtagtgggcaagcctgcgaatctcagcttgttggtcagggtgatcgctgatgaggggctcttgatgggaggcgcggttacggacgtggcggatgagctccacgttttcctcgaagtcgcgtcggctacgccccgggtagtgaggcatacctccgttacgtaagtcagtgagagctttccatacggttgcttccaggcgcggggtgagcagaaagcgccagttgtccagtgacagactcgccacgatctgatcaggggtcgcatcgagcctcgcgcgccgcagtcgcttctcggccctggcgacgttacgcgggaaaccaccgagccgatagctcggggattcccagcaacgccgtatgccagtatcggcgctcaggcgcacgtcaatgaagtttctcaggagtacctcgacatggctgatgtcttccaagaacgctttcgagatgcgggtgttccacacgtaccacgcatcgactggttcgatccggtagcggctgagcctggcgggtgagaaccactcctgcaacgtctcacgactcaccgtgggagcgtggtaggattgatgacgataggcctcgggaaggtcaatgccgcgaaatatcggtatacccccgaggtcattgttttgcccaggcccctcctcgcatacttgcggggcgtcattggctgccgtcatctcgtctcttcccggtacgtggctgtccatgttcacgggcaggtacggcaatgaggttcccgcacacaaacctctaccaagcatacgctggcaagcccc

SEQ ID NO: 154 - DNA, 1055 bp, Propionibacterium acnes
cccctaggtcctgatgtgggtcgaggtccttggaatgatggaagttcctacacacccatcgccaaagacctcaacatggacaacgctaccttcaccactccctcatctgtgaagagccagtttatgcacggtgttgaaagaggcgtcggtctacgacgaatgcgggttaatggtcttgtggtgtggggcgctgggcgatggcatcgagaacgcgtgagtgggtggcgatccattcggccgcgtcggggttgatgttgcgggcgacggtgtcgatcgctgttacgtagtgggcaagcctgcgaatctcagcttgttggtcagggtgagcgctgatgagaggctcttgatgggaggcgcggttacggacgtggcggatgagctccacgttttcctcgaagtcgcgtcggctacgccccgggtagtgaggcatacctccgttacgtaagtcagtgagagctttccatacggttgcttccaggcgcggggtgagcagaaagcgccagttgtccagtgacagactcgccacgatctgatcaggggtcgcatcgagcctcgcgcgccgcagtcgcttctcggccctgtcgacgttacgcgggaaaccaccgagccgatagctcggggattcccaccaacgccgtatgccagtatcggcgctcaggcgcacgtcaatgaagtttctcaggagtacctcgacatggctgatgtcttccaagaacgctttcgagatgcgggtgttccacacgtaccacgcatcgactggttcgatccggtagcggctgagcctggcgggtgagaaccactcctgcaacgtctcacgactcaccgtgggagcgtggtaagattgatgacgataggcctcgggaaggtcaatgccgcgaaatatcggtatacccccgaggtcattgtcttgcccaggcccctcctcgcatacttgcggggcgtcattggctgccgtcatctcgtctcttcccggtacgtggctgtccatgttcacgggcaggtacggcaatgaggttcccgcacacaaacctctaccaagcatacgctggcaagcc

SEQ ID NO: 155 - DNA, 1057 bp, Propionibacterium acnes
cccctaggtcctgatgtgggtcgaggtccttggaatgatggaagttcctacacacccatcgccaaagacctcaacatggacaacgctaccttcaccactccctcatctgtgaagagccagtttatgcacggtgttgaaagaggcgtcggtctacgacgaatgcgggttaatggtcttgcggtgtggggcgctgggcgatggcatcgagaacgcgtgagtgggtggcgatccattcggccgcgtcggggttgatgttgcgggcgacggtgtcgatcgctgttacgtagtgggcaagcctgcgaatctcagcttgttggtcagggtgagcgctgatgaggggctcttgatgggaggcgcggttacggacgtggcggatgagctccacgttttcctcgaagtcgcgtcggctacgccccgggtagtgaggcatacctccgttacgtaagtcagtgagagctttccatacggttgcttccaggcgcggggtgagcagaaagcgccagttgtccagtgacagactcgccacgatctgatcaggggtcgcatcgagcctcgcgcgccgcagtcgcttctcggccctgtcgacgttacgcgggaaaccaccgagccgatagctcggggattcccaccaacgccgtatgccagtatcggcgctcaggcgcacgtcaatgaagtttctcaggagtacctcgacatggctgatgtcttccaagaacgctttcgagatgcgggtgttccacacgtaccacgcatcgactggttcgatccggtagcggctgagcctggcgggtgagaaccactcctgcaacgtctcacgactcaccgtgggagcgtggtaggattgatgacgataggcctcgggaaggtcaatgccgcgaaatatcggtatacccccgaggtcattgttttgcccaggcccctcctcgcatacttgcggggcgtcattggctggcgtcatctcgtctcttcccggtacgtggctgtccatgttcacgggcaggtacggcaatgaggttcccgcacacaaacctctaccaagcatacgctggcaagcccc

SEQ ID NO: 156 - DNA, 1055 bp, Propionibacterium acnes
cccctaggtcctgatgtgggtcgaggtccttggaatgatggaagttcctacacacccatcgccaaagacctcaacatggacaacgctaccttcaccactccctcatctgtgaagagccagtttatgcacggtgttgaaagaggcgtcggtctacgacgaatgcgggttaatggtcttgcggtgtggggcgctgggcgatggcatcgagaacgcgtgagtgggtggcgatccattcggccgcgtcggggttgatgttgcgggcgacggtgtcgatcgctgttacgtagtgggcaagcctgcgaatctcagcttgttggtcagggtgagcgctgatgaggggctcttgatgggaggcgcggttacggacgtggcggatgagctccacgttttcctcgaagtcgcgtcggctacgccccgggtagtgaggcatacctccgttacgtaagtcagtgagagctttccatacggttgcttccaggcgcggggtgagcagaaagcgccagttgtccagtgacagactcgccacgatctgatcaggggtcgcatcgagcctcgcgcgccgcagtcgcttctcggccctgtcgacgttacgcgggaaaccaccgagccgatagctcggggattcccaccaacgccgtatgccagtatcggcgctcaggcgcacgtcaatgaagtttctcaggagtacctcgacatggctgatgtcttccaagaacgctttcgagatgcgggtgttccacacgtaccacgcatcgactggttcgatccggtagcggctgagcctggcgggtgagaaccactcctgcaacgtctcacgactcaccgtgggagcgtggtaagattgatgacgataggcctcgggaaggtcaatgccgcgaaatatcggtatacccccgaggtcattgtcttgcccaggcccctcctcgcatacttgcggggcgtcattggctgccgtcatctcgtctcttcccggtacgtggctgtccatgttcacgggcaggtacggcaatgaggttcccgcacacaaacctctaccaaacatacgctggcaagcc

SEQ ID NO: 157 - DNA, 1055 bp, Propionibacterium acnes
cccctaggtcctgatgtgggtcgaggtccttggaatgatggaagttcctacacacccatcgccaaagacctcaacatggacaacgctaccttcaccactccctcatctgtgaagagccagtttatgcacggtgttgaaagaggcgtcggtctacgacgaatgcgggttaatggtcttgcggtgtggggcgctgggcgatggcatcgagaacgcgtgagtgggtggcgatccattcggccgcgtcggggttgatgttgcgggcgacggtgtcgatcgctgttacgtagtgggcaagcctgcgaatctcagcttgttggtcagggtgagcgctgatgaggggctcttgatgggaggcgcggttacggacgtggcggatgagctccacgttttcctcgaagtcgcgtcggctacgccccgggtagtgaggcatacctccgttacgtaagtcagtgagagctttccatacggttgcttccaggcgcggggtgagcagaaagcgccagttgtccagtgacagactcgccacgatctgatcaggggtcgcatcgagccccgcgcgccgcagtcgcgcctcggccctggcgacgttacgcgggaaaccaccgagccgatagctcggggattcccaccaacgccgtatgccagtatcggcgctcaggcgcacgtcaatgaagtttctcaggagtacctcgacatggctgatgtcttccaagaacgctttcgagatgcaggtgttccacacgtaccacgcatcgactggttcgatccggtagcggctgagcctggcgggtgagaaccactcctgcaacgtctcacgactcaccgtgggagcgtggtaagattgatgacgataggcctcgggaaggtcaatgccgcgaaatatcggtatacccccgaggtcattgtcttgcccaggcccctcctcgcatacttgcggggcgtcattggctgccgtcatctcgtctcttcccggtacgtggctgtccatgttcacgggcaggtacggcaatgaggttcccgcacacaaacctctaccaagcatacgctggcaagcc

SEQ ID NO: 158 - DNA, 1055 bp, Propionibacterium acnes; identical to SEQ ID NO: 157

SEQ ID NO: 159 - DNA, 1055 bp, Propionibacterium acnes
cccctaggtcctgatgtgggtcgaggtccttggaatgatggaagttcctacacacccatcgccaaagacctcaacatggacaacgctaccttcaccactccctcatctgtgaagagccagtttatgcacggtgttgaaagaggcgtcggtctacgacgaatgcgggttaatggtcttgcggtgtggggcgctgggcgatggcatcgagaacgcgtgagtgggtggcgatccattcggccgcgtcggggttgatgttgcgggcgacggtgtcgatcgctgttacgtagtgggcaagcctgcgaatctcagcttgttggtcagggtgatcgctgatgagaggctcttgatgggaggcgcggttacggacgtggcggatgcgctccacgtttttctcgaagtcgcgtcggctacgccccgggtagtgaggcatacctccgttacgtaagtcagtgagagctttccatacggttgcttcccggcgcgaggtgagcagaaagcgccagctgtccagtgacagactcgccacgatctgatcaggggtcgcatcgcgccccgcgctccgcagtcgcgcctcggccctgtcgacgttacgcgggaaaccaccgacccgatatctcggggattcccaccaacaccgtctgccagtatcggcgctcaggcgcacgtcaatgaagtttctcaggagtacctcgacatggctgatgtcttccaagaacgctttcgagatgcgggtgttccacacgtaccacgcatcgactggttcgatccggtagcggctgagcctggcgggtgagaaccactcctgcaacgtctcacgactcaccgtgggagcgtggtaggattgatgacgataggcctcgggaaggtcaatgccgcgaaatatcggtatacccccgaggtcattgtcttgcccaggcccctcctcgcatacttgcggggcgtcattggctgccgtcatctcgtctcttcccggtacgtggctgtccatgttcacgggcaggtacggcaatgaggttcccgcacacaaacctctaccaagcatacgctggcaagcc

SEQ ID NO: 160 - DNA, 825 bp, Propionibacterium acnes
cgcacccgccgcatcgtgacctcatcctcacgctgccgatcaccgtcaaccagatggtcagccacgatggtgttcacaccccatgactcatgcagttgcctggccaaggcgcccaacacctgctgacgcacctgtgacttgacgtcatcatcctccagatcctgtgtaccaaccatcacggaggccaacacatcactgcgttgctgaaccagggtgttgacgacgtcgacatcgtcgatacccatgggattgttggcgcgcgcggccacggcatgaaacgtgttggactgcaaattctcgaccagaccacgccgatagtcgttgaactgggaggtgtcggcaatgacaccggtcatgatgtaggccgacccctcggacaaggccctgtaggactcgtcgacgaacgccaccaaccccggccgccgccggtaaagtcgacctgcttcctcgtcagccagcaaccatgacagtttttgccccatatgtcctccttgctgacatgacctcgaacatggtaaactttccgtaggaaaaacggggcaagtactttcgagcggctacctcggcccccggtgggctgtccagccttgtgcggaccgaagccgggggattccttatgtttgcggcaatgatgccgctgcaccccctcatgccgtggtgtggtcctttccccgtgtgcggtgtggtgcgtcgttgactggtttgtggccccgagccttactctgaccggtaggagaacggtgtggggtctacggatagcccactcggctcccggtggaatgtccaacagggtagggttgatgagttggtccatcaggaccgtcc

SEQ ID NO: 161 - DNA, 825 bp, Propionibacterium acnes; identical to SEQ ID NO: 160

SEQ ID NO: 162 - DNA, 821 bp, Propionibacterium acnes
cacccgccgcatcgtgacctcatcctcacgctgccgatcaccgtcaaccagatggtcagccacgatggtgttcacaccccatgactcatgcagttgcctggccaaggcgcccaacacctgctgacgcacctgtgacttgacgtcatcatcctccagatcctgtgtaccaaccatcacggaggccaacacatcactgcgttgctgaaccagggtgttgacgacgtcgacatcgtcgatacccatgggattgttggcgcgcgcggccacggcatgaaacgtgttggactgcaaattctcgaccagaccacgccgatagtcgttgaactgggaggtgtcggcaatgacaccggtcatgatgtaggccgacccctcggacaaggccctgtaggactcgtcgacgaacgccaccaaccccggccgccgccggtaaagtcgacctgcttcctcgtcagccagcaaccatgacagtttttgccccatatgtcctccttgctgacatgacctcgaacatggtaaactttccgtaggaaaaacggggcaagtactttcgagcggctacctcggcccccggtgggctgtccagccttgtgcggaccgaagccgggggattccttatgtttgcggcaatgatgccgctgcaccccctcatgccgtggtgtggtcctttccccgtgtgcggtgtggtgcgtcgttgactggtttgtggccccgagccttactctgaccggtaggagaacggtgtggggtctacggatagcccactcggctcccggtggaatgtccaacagggtagggttgatgagttggtccatcaggaccgt

SEQ ID NO: 163 - DNA, 769 bp, Propionibacterium acnes
ccttcaccactccctcatctgtgaagagccagtttatgcacggtgttgaaagaggcgtcggtctacgacgaatgcgggttaatggtcttgcggtgtggggcgctgggcgatggcatcgagaacgcgtgagtgggtggcgatccattcggccgcgtcggggttgatgttgcgggcgacggtgtcgatcgctgttacgtagtgggcaagcctgcgaatctcagcttgttggtcagggtgagcgctgatgagaggctcttgatgggaggcgcggttacggacgtggcggatgagctccacgttttcctcgaagtcgcgtcggctacgccccgggtagtgaggcatacctccgttacgtaagtcagtgagagctttccatacggttgcttccaggcgcggggtgagcagaaagcgccagttgtccagtgacagactcgccacgatctgatcaggggtcgcatcgagcctcgcgcgccgcagtcgcttctcggccctggcgacgttacgcgggaaaccaccgagccgatagctcggggattcccaccaacgccgtatgccagtatcggcgctcaggcgcacgtcaatgaagtttctcaggagtacctcgacatggctgatgtcttccaagaacgctttcgagatgcgggtgttccacacgtaccacgcatcgactggttcgatccggtagcggctgagcctggcgggtgagaaccactcctgcaacgtctcacgactcaccgtgggagcgtggtaggattgatgacgataggcc

SEQ ID NO: 164 - DNA, 603 bp, Propionibacterium acnes
accagatcggccacatccgtcttggcccatctccagcccgccagacccagggaggccatcacctcatcgacgccgcgccgggtggtctcatcaaccccgtcaaacagctcgggccacctcgatgatgccgtccgtgaacgatccagattcatgacatgctcctcttcacagatgccgacgacgatcaggccgtggccgtggcaacggggtgacctgccggcgcggctcacgacgttgagccggaaccacacgagacgcaccagtgtgctgcgccgtcttgagtcgggcgctgtactgggccctggcgctgtggtgaacagcccgacgaagcaccgaccgccggctgtcctcatcgccagggcgaggcatggggcgcggcatggtgcgcccggtagcagcatccatgagggtgatccggtcagccaaaatgccgagccggttttcccacttccggggccacggcaccagcaggtcacgctgacagcccacgccgtggcgtcggcagtccacaacattttctcacggccaggatgcgagtgcagcagctccaccggaacaccagcatcacgcacccgccgcatcgtgacctcatcctcacgtgcc

SEQ ID NO: 165 - DNA, 599 bp, Propionibacterium acnes; identical to SEQ ID NO: 100

SEQ ID NO: 166 - DNA, 599 bp, Propionibacterium acnes; identical to SEQ ID NO: 100

SEQ ID NO: 167 - DNA, 599 bp, Propionibacterium acnes; identical to SEQ ID NO: 100

SEQ ID NO: 168 - DNA, 599 bp, Propionibacterium acnes; identical to SEQ ID NO: 100

SEQ ID NO: 169 - DNA, 599 bp, Propionibacterium acnes; identical to SEQ ID NO: 100

SEQ ID NO: 170 - DNA, 599 bp, Propionibacterium acnes; identical to SEQ ID NO: 100

SEQ ID NO: 171 - DNA, 599 bp, Propionibacterium acnes; identical to SEQ ID NO: 100

SEQ ID NO: 172 - DNA, 599 bp, Propionibacterium acnes; identical to SEQ ID NO: 100

SEQ ID NO: 173 - DNA, 599 bp, Propionibacterium acnes; identical to SEQ ID NO: 100

SEQ ID NO: 174 - DNA, 599 bp, Propionibacterium acnes; identical to SEQ ID NO: 100

SEQ ID NO: 175 - DNA, 599 bp, Propionibacterium acnes; identical to SEQ ID NO: 100

SEQ ID NO: 176 - DNA, 645 bp, Propionibacterium acnes
ggttgatgagttggtccatcaggaccgtcccggtggctgcgtcaatgatcgatatttcgatgatgcgcccgtccaggtcggtggtttcggtgtcgaggatgactccgactccgggttctaggagttgttcggggatccaatgggtggtcatcgtgtggctcctacagggagtgtctgggtcgggcagcggtgcaatacccgcgccatagcggtcttctctgcggcggtgacccacagctggtacttcattttgacggcgatttggcgggccacatagtcgcatctgtaggccttgttagggggtagccaggtcgctgcatccctgtctcgtttggcctcattagcgggtccgtcgacagccagcaagttcaacgggtcgttggccagggcggtgcgttgcagcggtgagagtttttgcgcgccggtaatccacgcgttcccgagggctacgacgtggtcgatttggactgttgtcgaggtgtgccggccgcgccgccaggcgagtgtggacccggtgtaggggtcgtggagtcgcccggagacgaccacgcatcgtgatccgggtttcaggtgggcctcgaccaggtcgcgggcaagggcatcgttgcgggtgtcgcatccgttgtggccccaggggcgggtcaa

SEQ ID NO: 177 - DNA, 588 bp, Propionibacterium acnes
acaaacctctaccaagcatacgctggcaagcccccctctcggccccaccacaacatcaattgctgactcgaacacctttgaggcagcgctttcggcttgcgcaaccccacccacgacaccgtccgcttactactcgaagctgagggattcagaccccacctacaccctcgattgtgaagagcctccaaagcccgatacaacgtctggcgagacaccgtgaacgacctcgccaccgcagcaacgcaccagcagcgcgggatggcttggtattagcccagcgcagggcccccaggcaccagccctaacgaccccgcacccgacgtggctagaggataagccgcacgggaggactccatacccgccgactcattccagcccgccaccagccgagccatatgatcaaccgcccgcggtaaataatccagccactcacgccggtcgtacaaggaaccggccccgctccaggcgtgtgcccaggatcgccacaacacgtcgagctcgaccaccacgcccggaatagattcccactccaaatccggatcagcggccgccacgtaccagatcggccacatccgtcttggcccatct

SEQ ID NO: 178 - DNA, 588 bp, Propionibacterium acnes; identical to SEQ ID NO: 177

SEQ ID NO: 179 - DNA, 586 bp, Propionibacterium acnes
aaacctctaccaagcatacgctggcaagcccccctctcggccccaccacaacatcaattgctgactcgaacacctttgaggcagcgctttcggcttgcgcaaccccacccacgacaccgtccgcttactactcgaagctgagggattcagaccccacctacaccctcgattgtgaagagcctccaaagcccgatacaacgtctggcgagacaccgtgaacgacctcgccaccgcagcaacgcaccagcagcgcgggatggcttggtattagcccagcgcagggcccccaggcaccagccctaacgaccccgcacccgacgtggctagaggataagccgcacgggaggactccatacccgccgactcattccagcccgccaccagccgagccatatgatcaaccgcccgcggtaaataatccagccactcacgccggtcgtacaaggaaccggccccgctccaggcgtgtgcccaggatcgccacaacacgtcgagctcgaccaccacgcccggaatagattcccactccaaatccggatcagcggccgccacgtaccagatcggccacatccgtcttggcccatct

SEQ ID NO: 180 - DNA, 586 bp, Propionibacterium acnes; identical to SEQ ID NO: 179

SEQ ID NO: 181 - DNA, 584 bp, Propionibacterium acnes
aaacctctaccaagcatacgctggcaagcccccctctcggccccaccacaacatcaattgctgactcgaacacctttgaggcagcgctttcggcttgcgcaaccccacccacgacaccgtccgcttactactcgaagctgagggattcagaccccacctacaccctcgattgtgaagagcctccaaagcccgatacaacgtctggcgagacaccgtgaacgacctcgccaccgcagcaacgcaccagcagcgcgggatggcttggtattagcccagcgcagggcccccaggcaccagccctaacgaccccgcacccgacgtggctagaggataagccgcacgggaggactccatacccgccgactcattccagcccgccaccagccgagccatatgatcaaccgcccgcggtaaataatccagccactcacgccggtcgtacaaggaaccggccccgctccaggcgtgtgcccaggatcgccacaacacgtcgagctcgaccaccacgcccggaatagattcccactccaaatccggatcagcggccgccacgtaccagatcggccacatccgtcttggcccat

SEQ ID NO: 182 - DNA, 582 bp, Propionibacterium acnes
acctctaccaagcatacgctggcaagcccccctctcggccccaccacaacatcaattgctgactcgaacacctttgaggcagcgctttcggcttgcgcaaccccacccacgacaccgtccgcttactactcgaagctgagggattcagaccccacctacaccctcgattgtgaagagcctccaaagcccgatacaacgtctggcgagacaccgtgaacgacctcgccaccgcagcaacgcaccagcagcgcgggatggcttggtattagcccagcgcagggcccccaggcaccagccctaacgaccccgcacccgacgtggctagaggataagccgcacgggaggactccatacccgccgactcattccagcccgccaccagccgagccatatgatcaaccgcccgcggtaaataatccagccactcacgccggtcgtacaaggaaccggccccgctccaggcgtgtgcccaggatcgccacaacacgtcgagctcgaccaccacgcccggaatagattcccactccaaatccggatcagcggccgccacgtaccagatcggccacatccgtcttggcccat

SEQ ID NO: 183 - DNA, 592 bp, Propionibacterium acnes
cccctaggtcctgatgtgggtcgaggtccttggaatgatggaagttcctacacacccatcgccaaagacctcaacatggacaacgctaccttcaccactccctcatctgtgaagagccagtttatgcacggtgttgaaagaggcgtcggtctacgacgaatgcgggttaatggtcttgcggtgtggggcgctgggcgatggcatcgagaacgcgtgagtgggtggcgatccattcggccgcgtcggggttgatgttgcgggcgacggtgtcgatcgctgttacgtagtgggcaagcctgcgaatctcagcttgttggtcagggtgagcgctgatgaggggctcttgatgggaggcgcggttacggacgtggcggatgagctccacgttttcctcgaagtcgcgtcggctacgccccgggtagtgaggcatacctccgttacgtaagtcagtgagagctttccatacggttgcttccaggcgcggggtgagcagaaagcgccagttgtccagtgacagactcgccacgatctgatcaggggtcgcatcgagcctcgcgcgccgcagtcgcttctcggccctgtcgacgttacg

SEQ ID NO: 184 - DNA, 570 bp, Propionibacterium acnes
accagatcggccacatccgtcttggcccatctccagcccgccagacccagggaggccatcacctcatcgacgccgcgccgggtggtctcatcaaccccgtcaaacagctcgggccacctcgatgatgccgtccgtgaacgatccagattcatgacatgctcctcttcacagatgccgacgacgatcaggccgtggccgtggcaacggggtgacctgccggcgcggctcacgacgttgagccggaaccacacgagacgcaccagtgtgctgcgccgtcttgagtcgggcgctgtactgggccctggcgctgtggtgaacagcccgacgaagcaccgaccgccggctgtcctcatcgccagggcgaggcatggggcgcggcatggtgcgcccggtagcagcatccatgagggtgatccggtcagccaaaatgccgagccggttttcccacttccggggccacggcaccagcaggtcacgctgacagcccacgccgtggcgtcggcagtccacaacattttctcacggccaggatgcgagtgcagcagctccaccggaacaccagcatcacgc

SEQ ID NO: 185 - DNA, 570 bp, Propionibacterium acnes; identical to SEQ ID NO: 184

SEQ ID NO: 186 - DNA, 581 bp, Propionibacterium acnes
cccctaggtcctgatgtgggtcgaggtccttggaatgatggaagttcctacacacccatcgccaaagacctcaacatggacaacgctaccttcaccactccctcatccgtgaagagccagtttatgcacggtgttgaaagaggcgtcggtctacgacgaatgcgggttaatggtcttgcggtgtggggcgctgggcgatggcatcgagaacgcgtgagtgggtggcgatccattcggccgcgtcggggttgatgttgcgggcgacggtgtcgatcgctgttacgtagtgggcaagcctgcgaatctcagcttgttggtcagggtgagcgctgatgagaggctcttgatgggaggcgcggttacggacgtggcggatgagctccacgttttcctcgaagtcgcgtcggctacgccccgggtagtgaggcatacctccgttacgtaagtcagtgagagctttccatacggttgcttccaggcgcggggtgagcagaaagcgccagttgtccagtgacagactcgccacgatctgatcaggggtcgcatcgagccccgcgcgccgcagtcgcgcctcggccctg

SEQ ID NO: 187 - DNA, 48365 bp, Propionibacterium acnes
agcatctacggcgaaggccccgactgctccgtactcaccaaccgcatctacaccgaccagcccaccgatgtgaccgctgcactcgccgactacggcttcaccatcgacaccaccaacacatccaaaaccatcctcacgctcacccgcacagccaccatctcccacctgctagccatcctcgatggcctaccccaagctgaggggactcactggctcaacactcaacccgacctccaccacatcaccctcgacgactccaccaccggctgggccaccaaccgcaccgacgacaccgacaccggcgtctgctacgacaccagcacccacaactggcagatctgctgacagcatgacgggcctgcccttgagggcaggcccgctaccacctgactctccctccgaaaagagggaaccacctctcggccagagcggccgagcttgagagatgagagcaataacgttcatggtcgtctccccgagtggtggggtgcgttacttagcgccgccacacggtgacggtgtcagtgccgacaaacggagacccctcgggcccacgaatgaacggggccacccactgcaggcgtcggagactgcgcttgggaccgtagggctggtgtgtccaatgcccccgcaccacatgacgggtcgtcaaccgcctaccggtcgcatcggtggtggtgtgcacctgcctcataggccgcatatcgaccacatcgtccagcgtgtcgtctccgacgaacaaccttcgccccggcggcgaatcggtcgctgtacagctagagcccgcaagatcgtcacaggagtcccttccctcgggttgcgcctcccgttttttgtactaccatattggtatggccatcgagttcactgatagtgccggcaagcacgggttcactcgcgaggacgcaatccacgcgatgcagacccctgaggtcttcacgccccacttcgaccactcccgtaccgacggcccggatgtcgcggcatgggttggtcccgcgaggggagggaggaccatcgaggtgttcgccacgttggttcccccggacacggttaccgtcttccactgcatggacgtgcgagccacgaccatcgccaagctgaatggagagcgagcatgagcaccacccctgccgggttcgacttcgacgctctggccgagtgggccgagagcgatgaggcgacccacaccccgcaaaccagccccgtgttccggggcaaggacgccgcgcgcgccagccgcgcattcctcggccgaggacggcccaccctcggcgcggaccacgccaccggcgagggccggtcgccccgccgtcaggtacggctcgacgcacgcaccaacgcgcgactcgacgcctacgcagccgcaaccggcaccagcgcctcccagatcatccgcgacgccctcgctgactacctgcccgcctgatcccaccccaatccactcgggcgcctgtcagtgccccctcttctgggtggtggtccggggcgtcaccgccccggaccagttgggtagtcatctcagttgaaataagcgattagtgatacgcccctcctgctttccggtgctgtcatgagcgtctgacaacagcgacacctcggggcagccgacggacagtcctctggctgccgctctgatcccatgcccacggcacgaaggtgtcggacagctcggtctcgtcatgtgcccaaatagcgtcgtgggcctgtcgccaagcttctcgggagccccacacgggcacgaccgggccacaccggtgtcctggtctccagtgtcgcgacactgtcgatttcggtacgtgcaatgcggcggcggtttgacggatcgacatcccagactcccgcgcgtcccagatcgccatgtggagagtatttgcctccagtgcggccgccacacttgcacgctctcgcgcacgctcgaatgcccgcctagtgctctcaaatgtcgtcacgacgcctccccctgaaaatactcagggtgtcccacggtgggacaccctgagtatttcataccccaactcgcctcaccacacgtcgacctcgacaccgatcaagcgacccgtatcagcgacattgccgtaccgctgccccgcctggtcctccagccacgacaacgcatcccgaaacagcccgacgtcttccaaagctaaaccacagtcgtagccgcccttgtcccccaaccgcacaatctggcgctcccggtggcctccctcgtcgacctcgatccacagtttcgcgtgcatccgctggcctcggccctctgacaggatctcggtgagcaggtcggaggcttgtcctcgcgcatcctcgttactgcgggggaattggagtatgtgggaggaacgacgatgggggaggttggtgacctcgtgacgcagcaggttgcgcttgtgcatctgctgatcgagacgctcgggctgacctgttgacggggttgagccgtggcgccgcttcctcggcggggtctcgatccgttgctcttccggcggttcggcgtcaggttgtggtgcgcgatctcccctaggacgggggggctcgccacctatatccgagggacgatgagacggccttccacgcttgctgcgtaccttcgcggtccggcctttgcgatcatgccgacgccgcggcggggtaacctcctcgccccgctccaactgtgttaacgcctcgaccaggttggtgccaggcttaagccctttcagcacgaaccgcaccaggcgggggtctcggccgattcgtcgggcaatctcggcttggctccacccttcggctaacagggtgcgcaccaagtcctgagcccgattgtcacgctcagtcactggtcgcctcctcggggagtcctacttgctcggcctgctctgatagagcagcccgctccgatccggtctgaggcgcttccaaagggcccggcaagacacctttgacacgcagccgcccgtccttgccgtcatcgccgcccccctgggccacagggagcgcccaggggggcacgttgctggtgtagatggcgtcgccgtggatagccagcagggtgcgggagttcatgcgtagtgctcctcccttggttgtggcgttttttccggtggtggggtcggcgatgggtgtgttgagggtgcgtacgcgggacagggcccagatgcgggcggcgatttcggggtgccaggtgtcggggtcggggcggcggcgggcggtttggtattggtaggcgatggtgtcaccggttttgttgcggatgacgtcgaagccttcgatgtcggaggggatgtcgtcggcgtcgtagacgacggtggtggtgacggggttggaggccgacatttggccgatggtcacgcgcagcatgtttttcaacgcggaggtgaggattgtcgtggcggtggggtttttgtctgcccagcgtttctcggcgatgtcgatcatgtcttggatggttttgacccatcctcggatgggatcgactttggtcagtttgatcccttcgaggaactcgatgggctgggtgatgggcccatctggtccggcttcggtgtcccagccttcgtcgatggctagtttcagttcggcggtatcgacccatgtttcgtgggtggtgccgggcacgttgggccaaaaccatcctgctcgtcctttggtgcgtttgaccggtagtaggccgatgtcgtcccaccaggatggcacggtgaagcggatgtggtagcgggccgggtgccaggggttgttggtgaacaggtcgcgggcttcggtggcgctgagcagagtggcgggtgcggcaccgatctctccggtcactgatccggcatacatgaatcggccgtcgatgtacacgaagttagggatagggccggcaggcacggtggggcgccagcccttttcgcggtcctcggggttgccgtcgtcgacgcatagttcgtagcggtgctgaggggaggtgtgttggatgagtgcgcccagttcggggtccatcggctccatgcgataggactcgggggtccgtagcttccagaggttgattccttctgctccggggcggtccatgagggcccagtcgcggtcgattctggtggcgatgatgtgggttaattcgcgccatgcccagcgggcctggattggggtgagggtctggccagggaaccattcatcagcgaccagaatgtcgaggttgcggtcggtttctttgtgggtgaaccggcctcgggcgggccgcccggacagcatgaacaggccccgcacgtgccagtcctggttgaactcgcgggtgtgagcgggggtgtcaggcagcagccaggattgaggctggtcggggatgttaccgcagacgatcaggcgtcgggcgttgtggtgtagcgcggttgttagcaggtctgacagggtcgcgtgcttggtgcgtcgtccccccagcactggcaggatctcgtttccggccgcgtcgactccccgggcggtgtcgatgtctagccacactgtttcggggtcggggggccgatgtggggcgggacggcgctgctcctggtcgtctctcatggtttcctcctttgggccagggagcggccggcgtcgagggcgttcatgcgctcgcgttgttcttcgcgtagttggtagacccggcctcgtgacactcctgctgcctcggcgatggtggtggccggcaggtggccgatggcggcagcgtcggcaaggacgtcacgccaggccaggtcaatggttcccagctgggctagagcttcgtcgcggcggcgggtggcatcagccactacggaggcccaccctgtggggtggatggtcttgacgacgattcggttgtggcggatggggccccatgcatcagcggggacttgccagccgtgattggcggcggactcggtgatcttgaggcgtcgctcaggtgcgcgggtgcgggcagtgacgtcggtgttccaggtctggactggtacccacgtcccctctcggatgcgttcgatgacgcacgtggtgacctcgtcggtgactgtgatgaccagacgataatctttcccgtctggggtggttcggtagctgggcatttcaccctcccctatctgtcaaatgagctagacacagtgtctatttaatttgacgcaaagtcaagtgtgctagacgcctttgtgtggatccgcccgcccagacaggcactcacgtctcatgacccgccgcgacgtcttaacgaaaccaaaccgcttatagaaccgctccgcagcgggcccggagggcttcagttcgagggtgagaccgtgctcgtcggcccattggcagacttgtgtgaggatctgtgagccgtggccttgagtgtgggggacggcgtggacgcacatgagcatggggccgtggcggcgcgctggcggggccacgtaggctccgccatgccagtccggtgtggtctgccagcttcgccatgtcgcggtacgccagtggtgggcttcgagggccaccatgatcaccgcgacgacgacgagcgttgcggccccgatcatggccagctcaccctgaccaggccagttcccgcagatgatccagtctcttaacgcccagatgatcgcggcttccacgcctgctgcgatcgggatgagcaaggcagaacgaaggtgtcctgccatgatctcggtgatctcgctgcgatgccatgacaaggagaattcccacgactcttgaatcatgctgatgtgtgaacggcttcttcggcttcgccctgccatagtttctccaaacgacgctcagccagctcgtcgggacacggcgacagcctgccgcactcggagcagaccccgaagtggcgcgagagagtgatgaccggctcgtcgggagcatgaaccgactcgatgcccgggtgctgctcatcggtgagtcccgaagcgtggctgatctcgatcagacggaggtggaccatgccgtcgtagctgtcggctctctcgacatggaacgggtaggagccgtccgcggtgtggcctgcaaccaggtccccgatcttcaactggctggcggtcatggttcgcaccggcggcagcggggtccgggtcgcgttgatcctcatggtctctccttgcttctgcgccttcatagatgaaggtgccacagccggggttgatgtgcggaaccacagccactttttcaataaatccatcaccacggtctcaccccttcccaaatgtgtaaaccatgatttacacatttggggcatgatcgaacccacaaccatctccaccacgccccgcgtggccatcatctcccccagcgggccagcacggttctggggcgagcctcccagcatcgcactgcgccgacacggccggtcccccatgaggtcccttccttccggggccctgctgctggtgtgggacgtcaccgttttgaccgggcccactctcggccaccgcgtgcgtcctctcagtaaggacgccgagctgactgcccggcgctggctcgaccaggtcgccgacaaccccggcttcctcgacacccttatcgaggccgcccgcatcaccgatggatggcatcacgcgacgcctccgcacattcaggccccttaccggacccttcatcagtgaacggaggtacaacgacatgaccagcgacattgacattgaccggacccacaaacccgacgaccgcgccgaggctcctctttaccggtcctgggccaggagactcgtgcacgtctccgggatgccctggcgtatcgtcgccgccttggccggggtctcccccacctccatgcaccggcttctattcggccgcaacggtcgacccgtggaatggatcggcatcaatgatgctcgcgccctgatggatatcggcatcgatgatctcgcctcagcgtccaccgaccgtatcccggcccgcgaatcccgcgagctgttggtagccctgcacaccctcggctggaccgatgagcatctaagccgctggctgaccagttccgacctcgacctggccaccacccccaaggccctctacgtcacccggctatccgccgcccgcatccaggccacctacgacatgctcatcagccagcccgtccgccgctgcggccacccccgcaccccgcctatctcgtcccagactccggttacctcgccccagcccgggcccgaggatgccgaaacgttccagcccgccctgttcgagctagccgactgcgcatgagaccccacacaaacatggttgaatcgaagggctcagccagcagccagttaccaggagtccccgtgcgtctataccgcgctgttcttacccacaccgacatccagatcaccgtccgcatctggagcaccaccgaccacgactggacctggactcccctcgacacctggacccccgacccgaccccgaccacaccagcccaactggccgacgaactccaccgacacggatggaccacccccgaggaccccaccaccctcaccaaggtgactgtgatccccgagaactggcaggccctcgtcgaccacgccctcgctgcccgaaaccaccaagccaaccagctgcgcgtcgccgagaacatcctcaccgacatcctcggcgacgccgccgacgctggcctttccgtgaccttcctcgcccaggctgccggattgtcccgagctgccttctacaaacgcagcgctaagaccatcaactctatgaggcacgccgaccagccgcgcgaagacccctcccagctcacccgagccgagaaaacagcactcagcctgggcgacgagtgatcctcacacctcctgcgacagcccggccgtggagccttcccacacgtgtctagccagcactgaccgggaaaacctattcgcggcaccacaccgggcccactcaccagtcacctacacccccgactgcccctcgcgaagacccaaccagcgaaccaagtccccaatgcgcccaccacgatcagcacacccacggcgaccaccaggtgggaagcactaaccgaccccaacaacccaagatcaaacaggccctgcccgggaacgccgagcagcccgtgatcgcgaagccatgctccgagatgaccgatgattttaggggccatcttcttcagcagggctatccctccgataccaacaacgatgaaggcgaggatttcttcgcatccgttgtttccttctccggtggggccgttcatgctgccttctcggggtggacggccagccagccgatgaggttgtcggcgacctgtcctgaggtttcgatcagttcgacctgtccggcctgccatgcccgtgatgtgccggccagcaatgatgccggggcccctgctgcgcggctgagagaagcgacttcagtcaaggcggtgcgtagctcctcgatggcgctttcgatgtaccaactgccgtcagtactagtctcagcggcatcggtggtagcgataagagcatcggtgaggtcgtcgacggcgcggtccagatcagcgatgtccggtagggctacaggagtcatggtgtgtcttccttctagggtgccttcactggtgaagggtccctagccccggccgatgtgcggtgctgtgggaaaaatgcttcccattggtccgtcttagttaggaaacttggcctaagtgctgtcgagggtcgcgtgttcgtgaccggttcgaagacactgccgccttgccttcttgtcagtggcgcttccgagatggggtcagtgggcgatggctaggccgatgagggcgccgctgcacaggctgggcgcccagggaaggaatcgggtggtgtggtgtcggaaccgatcgattagggcatatagggcgatcagagtcagcccggcgatgaccgtggcgtggatcgtgtcgatgccggttgctgcggccggggctgcccacagtggtgtgatgcgcacgtcggagaagccgaagccgcctcgggagatgacccagacgatcatccacgctgcgaagatgatggcggtagcgatgacagcacgtatcgccgcagtatggtccgagagggcggtaacgactacagccccgatccatccggcccatccggtccacgctaggactgccggtatccatgtggtgatggcgtcaatgacggcaacccatgccccgatggtggctagcagagcccaggccggccaggtgggtgctggggcccacgctacggcggcgatcatggttgtcgcagatgcagcacagacagcgatcaagcttcggagactgtaggtgtcgcggtaggcgatcttgtcggggctggcggtagctggttctggcaggacgcgggtgagggcaggccaccctgcggccgcaatagccatcacggcgaccacccacacaatctgttgcatgggtctcatcatggcccatcaacgccgaaaatgggtggccgacatgggttcactcgtcaagaggtgtacgggcggccgtggcttctcctgcgccgagcatgagggtgccagaatcctcgccagccgattcccagtcgacgatgacctggtcgccgtcaacgctggattcggcgatggtcacccattgcccgtccatgtcgatgagcatcccggcggccagctctgtggcggcaaccgggtgggctgggctgtagaggaggtcgatgtcgcgggcagggtcgtcgggttcttcggttacctcgggtggggtcgatctggctgtctcggtgtcgtcggccaggtcggctcccaggatgcgttcccattcggggctggttttcttgcccgctgaggccatcgtctcgtcgatctgttcgtcagtgggccacacaaatttctttttggtccaggtcgtggtgtcgggtcgcagctgatccagcagttccaggtcttgcggggagtgggccttgcgggggtcgggggtgtagaagaattggacttccttgggggctgattcgccggataggtaggtgccgcggccgcgtttgccgaacgggatgcccacgccgacgtgttcggagccgaacatcatgcgggctccgtcagcggacaggggtccggtggcggcacgcccggagaagttgtctcggatttcgccgcccaggaactcggcgtcggggcgttgggtccccagatcgacgtggatacggcaggcggctgccatgcgcagcagggagccgatccagccgaaaacggggcattctccgggcatcccagagaccttgatcgttgaccaccagtttttcgcgttgccgtagaactggcggtactcgtcgatgaggaccagcacgcgggtgaagtcggtctcgcgagccccttcttcttcgatgcggcggtagcggtcctccatgagagaccacagccagtggatgagggcgacctggtcggggacggtagtggcgaccatctcgatgttgggccactcccgcaggcccaggtactcgatgcgtttagggtcgatgacgaagacgcgccagttgcggcgggcaccctcgacggcgtcgccgatcatggacaccgtttttccggtacgggtgcggccggccttgagctggtgggccatgacaccggagatgtcccagaaacaggtgttgccgtcctcgtcgacggcctgggggattttctcccagtctggggagtctgggcccggaagggccacgggtcggggcaccatcgagggcagggggtggcggcgggtgacggtgatggtgtcgtgttccaggtcgaagtcgctgcgccactggccgagcatcatcgccgaggtcaccgcggccaggcgcaattggatgttcgggctggacaaatgggcgccacgttggtggtgaatggtgaagccgtccaggttcccccgatcggttttccaggaatcgacggtgaccgccgacccatagatctgagtggctacttctttagcccgttccttgtctcggtccagatcggttttgtcagggtcaggggtcggggcgcggtattgcaggacgaacccgccggccgggatcgttgcggatgtcaccgtgaactctgccggcgaccaggcagccgcggccgcctgggtgagggccattggcatggtctcgacggcagcctcctcgggggggatggtgagggtcaggcgtcgcggatgcgtcttcttgcgattccatgtgactttctgcctcaccggcaccttcgccgccgactgaatggctaggcgagctgattcggcagtttcggtacgccggccagcgcgtagcgcccgtcgtgcgtgaaggctgcccaccacagcacagcccatacacggcagccaccagcgcggatcagcggctgctgcatagcccccggtagctagtaccgcacctgaccagccggccgcgatacttttccacgccggtttcgcgccaccaggaccagcgttatggacggtctgcttcgaggctgcggagggacgagacagcggagtgctggtcatgccgcggcctccttgtggcaggtcatttcacaggcatgccggccagcgatgatgccgtggcgcaccgccccggtagccgcatagaccgcgcacaactcaaacacggggcacccatcgcaggccgccgggttcatgctttctttgtcccacgatggtgggtcatcggtgcacggcacggccaggccatcctgttgagcggcgctgatagcggtgaataggcgcagctgggcgcgaacttggtctggggtcaggttgacggtgcgggctacacgcatggggttccttcctcttcaccagtgaaggttccctagacccggccgatgtgcggagggatttcagtgttttatcgaggtgaccagccagccggtctgcgctgcgggttcaggtaccagggtcagatgcagcatggtgtggtcggctaggggcacggcgaccaggggcccgtcggcgctcgccccggtgagggtgggagttccggccacggtggtggcgggaatctggttgggtttcgcggccatcagggagcccatgagggtcggggcggcgatctggacgagggcgactttgcgggcggcgggatcgcgggtcaaccagccgcgggtgaaggtgagcgcagccgacgtgatatcggggctcagcggggctggtgtggcggcggggtgggccgttgaggagggccatacgcgcggtagcgctggcgacatcgagcgggtcggagtggggtcaggtgtggggcttagggtccgatgtggcgatggggctaccgccccggtggtgggagacgagactggttgggggtggtgttgagggcgtgggatcagggtgaaggcagccaaactggccgggatgaggatgacggccgcgccgacacttcggagcgaggtcatgtgacgatccttcggtagctcgacgggttgccgtagatcttttccacgttgatgccactatgtgggttgtcggcgctaaccatttggcctccaccgatgtagacggccacgtggtgggcagggcttccccagaggatgaggtcgccgactttgagctggtcacgggccaccgcggtgccgactttctgctggtcggcggcggtgcggggaaggctaatgccgatacgccggtacagcgccgaggtcaggcctgagcagtcgtagccgccatcggctttgccgttgccaccccacacgtaggcgtaggagttgttgtcggcgatcgatttggcccatgccacggcttcggccaggttcttcgacacaccggtctcgttagcggccccggtggcacagttgtttgacaggtgccctgtagtagtggatcccactatttgtttggccatggtttcccatttggcgtaggcatcgggcagggctgagccttgcactgcctgagctgcctgcgtcagcggcatcttctgccagtcagcgatgtcgactaaaccgggaatgtggaatccagggccgccggccgatccggggccagcgtaggtgatggtgtggcctttcaagaacgcctcggtggcgtaggcatcattgttgacctgatccagagtcccgtaccagcccggcaggatgcgctgctgaaaggggccggcgtcaccgtcaccgttagccttcgctgaggtagggtcggccccaagatctgattcttgtttggcggtcatgatagcgatgaccgctgcctgggtaggcagtttgtcacgctggaccacagtgacgatggtggtcacgagctgcttctgcctggccgtgaggcctccggcacccacagtgcctccggtgacggtacccacgcaagcatccccgccgacactgccaccgccgccagagttgtcgtcgagggccccagagcctactgacagcagcggcacaatgatcacggtcgcgggcaagaccgccaggcccgccagcatcagcactgctgcactcaccacggcgatcacgtgagatgctttcaacgctgcccacctttcgctggtttgagggggcgacgcctgctggtacgcacaggcttggttggtccagtccgccgttggttggcaggcctgggtttgatcggcttgctgggacccggtttgggctccggagtcttaggctccggcttcacatgcctaggcacttcggctgcggtgggaggagtcagcacgtggcgtaccggcttggtgaccttctgggcacccgaaacaaccggcttagacaccaccttggcacctttgaccaccggtgcggctgccttcgcgccggccttcttgactgcacgatgcgctttgatagccccggcctcggcccggccaaccctgctagcagtagcatcgagggctctgtggcccgtcgttgccctcaccggtgcatccttgccctggcgggtctgcttagcgatcgccgacatgccgcctcgcaatgccgaaacatgattgtgggcgtgggcgatcgccgacatgccggccgtcgcgatttttgactggccctgcggggcccctgccccagcacgaatctgctggtaagccgccgacgtgccacgagcacccgccgccattcgcgccaccttcgcagccctagtcactcccgtcgacacgccacccgtggctaccgcagcagcacccgagaccacagtcgaggccatccgccttcgacccaatccggtgagcttgcgaccaccgctgcgcaccatccggcgagcaccccgcccagcccactggccaatcgccgacgccccttcggaacgcttgctgcgcatccaatcgttgatcttgtccctcagccccttctcgcccttgtgacgacgccacatggacatcaagaacccgataatccccacgagctcgagcatgttgacaaccatgaccttgatggcgacatcaccgtcagaggcgaaaaccgacttgatgatgagcatgaccacacccaacatcaccatcgacccgacaatgccgatcatcgagtacaagatcgaacacagatcccggatgagcggatctgtgcggccagggatagcccgcaacacgttgagcatcgacatgaacgccgaccacaccaacttgcacacgtagaaccagcacatgcccgcgaacaccagcaggaccacagccaaacccgccaccgtcgacgagtaaaagaagaaccccaccaaccacgaaccatccgcaatatcgccggcgtaatccgacaacccctcatcacagtcaccaaggtcgtcgcgagcatccgagacgtcatcgtaagggccacccttgagcacctcgatgtacttgtcgtggcacttcgcatcaataatgcggccatagttgagctgctgatgaaccggcgccacgaacgagtccacaatgatcgccgacagcttcggatccttcgagtctcccgtcgaggtcatgtcatcaggaatctcgacctcaccagcggtcgccgtcgcaggatcaaccgaactggtaatcatatgagacagcgccacaccgaactgctgggtgcgagccagcggagtagccaacgtcgtcgtatcgcctgcgaacttcgccaccggggccgccaagaaacccaacgccagcgccgcagcaatcgccgcacgcgcacccgtagcccacgcccctgccgtacgtcccctcatcatcttgacgaccacgcccacaccggcgcacgtcgtcagcaacgtcaacaccgttccaccccagctgtccgctcccagcggggccaaaaccttgtcgtggatgtcgttctgtaaccccaccagcggtccggtaatccacccgacccagctcatcgccacggtccagtccaacaaccggcacaacagggcaatgaccatcaggtacgtgttccaacacatgccaataatggaggcccacatagccttcagcggggccgtaacgccaccatcgtccatcgacatctggtactgaaacaagtgaataccgttggagtcagtcacattgaaaccgtcacccatccagcccagccccgggcccgatgccatggcaggcacactgctcagcgccaccaccagaaccagcgtggtgacgatgatacggaaccgccgctccccggccccggggcggcgtggatgacggctcacgctgtctcctggtcgtgctcgggcgggttggagctggcggcttcgcggtggggagcgtaggcaggtctcagtagtcgaatttcaccgacgttgccgtgttggtcggcgtacaggccacaaccggggcctccggggttgagggcaatcttgaccaggtcagcgaactcttcaggggacgttttagggtccacgcccaggaactcgacacctttctgggcgaggttgatgttgtcgcacagcaacacgatgcgatgctgaatgaggttgcggacggtctcgttggggtaatcggcctcggggtcgtgggagccggtgataagccaggcattggctcggcgggattcgcgcacgtactcgtcaatggcgtgggaggcttccggcgaggacgacatgtgatgaaactcgtcaacaatgaaagcggcgtcgcgggcccggtcgctgaagcacaccaggcgagccagacgggcaatgagcgcgtagagggctcggccaaacaccttgtgcgggggcagctgccgaaacagatgttctgacagcatctcctcggcgttaggaagagcgatgccacaagtgccaatgatgaggatgtcggcactcaggtcggcgggaggaaggtccgggtcaaagatggccgaagctagggaggccgagttctcgatgtcagcgaacacggcaatcctgtcagcgatcgcggtggcctcgggaaggtcgcactcctcggccaggtggcgggccaaacgcccacacgaggtgatctggtggtcacgcatgtaggccggtttgaggaccttggccagcgtggtcccggccacaccgatggtctccaagttaagcaaggtcagcaagaacgactgggcgacctgcccggccatctccgggggaaggatgcgcagcgggtccagcgacagcttggggtgggccgtgtcgacgatctggcgtctaaccccgtcgatagagttgacaaaggttacccactcccgctcatcggagttgtcggtggcaataatgcgcccgccccgggccgcgatggctgcgcacagccgcttctcggccatcgtcttgcccgcgcccatcttgccgatgaacgccaccgtgttgcctttctgatcctgagtgtcggcatgcaaatcgaggtaggccagcgactgcaacggggagcctgtgaccacagccaacgggatgccggtggtacggcccaaccggtactcaaccaccgggatagatgcggcgaacgcggaggcgtgagtcagctgacggtaggcgttaagcgaggaggagaaccggccaccgggccgggcagcccacagcaagtcctcctgacggcccacgggacgcacccacgtgaagtcaccgaacaccggatcattgacgaacgctcctgccagctcctcggtggtctcaaagtcaggagacgagacagtgacggtgataagagcctggatctcgacctcacgctcatcggcggccagctcggcgttgtagtcgacgagcacctgagcggaatgctcgatagacatgagggtcgaagcctgggtcatctcaccgccctcgacgttgtcgagctgatcgaccgtttgacggatagcccgctgatttttctgcatcgcagcgtgacgggtccgggccactccccggatcgccacgtcgaccggcacgccagtgtcgtcgatacggcccaaaaactcgtaggcaggccacgtcatcgtgcggggcaccttacccagcacgatatgggactggtagacggtctcgccggtgtcggcaccgattttgaggacgcgacgattccacgcctgagccgtccgggacatgtgggagactcgcttgtcatcctcgctggccagcaggtcggaggtcgcggcctcatcgatgaccaactcccccagcgcggcacgtccaacctcatccatgagggcgattccctcgccaggggcatcatcacgcaaccgggtcgggtggcctgacaggtgctgccgaagccagatctgttcatcaacggtgaccgggcggggttggaacgctgccggcagtttcgcaccgaattccttagcctgacggagggcccactcccgtgcgacacggccaggagcggtggtcatgagtccggcggcttcggtgattttgttgagggcggcggtccaggcggtgtgggtgcgtattttctggtcttggttgagtttgatcgataggaaccacacgcgccggcctagggattcggtttcaggctggtcgagggtggcgtcgatttcgtcggcccacacggggtgttcgctcaggtcgaggccggcggccatggcgtcgacgatttctgtggggtcggtccaggtgagggctccgttgaggcagaactcgtggcgggcgaggtggcggaataggtcgcggtgagctgcggcgacggtgagggaggcgttctcggtgacgggtcgctggaggggagtgagtcgccaggtggcccagatgtcgccggtggaggtccagacgaggttgtcgaagaggaaccgttcggggatggacatcatgactccttttcggcggcggcgaggaaggcttccaggccgctgcggcgtacagcgttcccggtagggtgcaggggttttctgggggtgggttcagatttcgaatgtgggaggggtttgtggatggtatcggtgtcctcggcgagggcttggtcgagcaggcaggtggccggggtgtcggtagtctcgtccagctcgtcgatcatctcgtcgaggaggttgggggtggtggatgcggcccacacaggtgggatagccggtgcgggtcgaggcggtgtggggaggcggagtttggtttggccccagaggggtgtgtgggtcatgccggcgggagtggtggcggcgtgagtggtcacacgccaccagcccgccagccatgccagaggtgaccaggtccagtcgatgcgaccaacaacgaactgggcgagccatccggcagccagcgcgaaaatgaaaccgcggatggtcatgcccccgtcgataattttgaagcccatcattgcggcaggaactacgccgccgacagcgagcacctgatagatcgtgtagggcccgccaggaatccttcgacctgaggaatccttaccgataatgcggggctgctggcgggcctcggtgtgccactgaatatccacgatcagctcttgcccaatccttgcatcatctgtccgaagaattggatcgcgttaccttcgataagccagtgcgccataccacacacaaacagcatggagacgatcttggccaggctcataccgtgtttgaagatgttgaacgcggcaatgcccacgactacgaccatggcgacggctcgcaccgcggactgaccttcacctgccttgatcgtcgtccattcgaagaggttctgcgattccagtggcagcaggaggaattgatcgagcatgagaggttttcctttcaggaagccgaccgggatggtcccggtactgacgggctggacggcacgggtgtgccggccaggggcagaaggcgtgacggctggtcgagggaggcaacctcccagcggcctgcacggctgacaagagtcaggccgtactggctggtccgggtagtggattcgtcgccggtgggctggcatgtcacggtcaccgtgacggtaatcttctgccggtctgagggggtggggacctcgtcaggtcccaccacatgagtggttttcactgatacgcatggggctgggtcaaccgcggtgaaagcggtccctgggctgctccatctcgacaggtcagtattcccggtcagcatggcggttaggaagcctgaagaggcttgggcggccgggtcggcggtgcgaagctccgaggtgtctagggtgggggccgaggccggtgcaggcatggggatctgtccaggtagacgcaaggcgatggccttgccgttggaatcgacgtggaccgggactgaccaggcctgtccgctcccggattggccgcccatggtgaccacggtgacctgccacaggctcggatcagacggggagacggtagcgtcataggcggtgacggtggtgggcgctggaccaggtttgcggggcatgcgcgcatcggtgatcttggccgccaccaggtgttccagattgtccaagtgcccggagtcagaggtcagcagaagagtagtcacctcgaccgcggtggctgaggcgatctgagctgtgcggcggtcgtgatgggtggtgtcagtgctgacagctgtggtgggagcggatgccggggccgccgaacggaccagggcaacggggccgcatgcgactccgcacagcacgagggcaaggaagcctttggtggccatcgatccggtgtggggccagggacccacgttttcctgtgcctgttttttcttggccgaccaacggcgggacttagggttagcggatgcaccttctggggtgcatgctcgtctcaatcgcatcggtcacctccttcactggatgaagggaccaaggaggtgaccgatgtgcggtcgaacccgaaaaagttcaaacttttttctgggtctgcctcaagtacgacagaaggcctgcatcatcacggcgttgtggtagcagatcttgcgtcagcgcaaatgtatgggcctcgtaggagtagctcttaggtgggtcccggtggttgcggccagggcgagggtgtcgggtatgtgtagcgctagtcccgggttcgtggtgtgagggcttttgggtgctgacatgcactacccattgctagacgctgtgctgtggcatggctggacgtctagcagacgggttgacatcacctttaggctggcagcgcccgaggccgcaggccagaggaagcggacagcctaacgattgacgtccccctctcctttccccaacctcctggatgtgtgggatcagctgtgccgctcccccgacatggcagacagcaccgttgcatgagaactgactgacactgtggcgccgcggaggtctcccgcggcgtccgctggggcgagtgcatgcctgtcagctcatcttttatcgtcatgtttccccttgtcagagcggtctttgcaaagtgacaacgtcaggggtcttgacgacaacatcctcgacaacatcgtggcggtggtctgtgtctcgtcagttcaacgcaccggggaaagaggcaccgctgatgttcaccaccacaaacaccctcaacgatgagtgggaccagattcgcgccactgagatcgattggcatgactgccctgaactgatgcactgcatcgacgttgatgatgtgttggccgtcattcctgccgcccccgacgccatcttgggctacctcattgcccgggctcagggcggtgacgagttggccacccgcactatcatccaagcgttcacaggcaagcttatcttgatggccacggccaccaaggtgcgccgtactaatgacggcttcaatgatctgttggcgggtctgtgggagacgatcatcacgtacccgttggatcgtcgccctgacaagatcgctgcgaacctcatcctcgacacgttgcaccgggttacccggttctggcgtgctgattcccccgatgaggaagaggctcacggtctggtgcccttccctgacactctcatcgccccagagcccgatgaggacgtcacagctagccaggccatcgccttggcggtggaccgcaactggattaccgaggacctagcccgcctcatgagccatatttactgtgacggtatgactggagctgatgcgggtcgtctgcatggctgcgctccagctacggtgcgatctcgatgccgtgatggtcgggccgtgttgcagcgcaacgccgagacgatcctggccgtctgctgatccctctcttgctcatgcctgccgccaccctacccctacctgctagaaacatagccatgtctccagcaacgcatctagcatatcttctagcaattgatctagctatgtatatagctgatgatctagctatcatatagctgtgtctccagcccaaaggacagcccaatggcatgcttgccacaggaaggtgcgtcagcctcccgaaatactggaaggagctttaccgtgcaggacatgacctcgaccagaccgattgaccgatccccgttcgaccgcactattgcggtgtggaaccacaaaggcggcacgttcaagacgtccgtcgtggcgaacctgggatacctgttcgccgccggtggcaacaaggtgctgctggtcgacatggacccccaggccaatctcgacattgacttcggtatacccgcgggagaacgtgaacggggcatgggattagccgaggcgctacgtgaggggacggcccttcccccaccgcagcatctcagcgaaaaccttcacctggtcagtggcggcgctgctctcaacgagttcaccgaccccgcatccttagcggccatcctcgaccgagtcaccaccgcacgctacgacctgctagctcaggcccttgccccgctggcctgggactatgacctcatcttcatcgactccgggccggcacaaactctgctgtcccagaccatccttggagtagcccgctggctggtagtgcccacccgcaccgataacgcctcaatcactggcctcgtcgacgttcaagacgccatcgacggggttgcctcctgcaaccctgaccttcaactactcggcgttgtcctagccggcgtgggggcccgggccacccggatcgccgcagataaacgccacgccatcgacacagtgctgggggcaggaaccgttttcgatgcggtcatccactactccgagaaggtgtccgtgctcgcacgccagcagggcaagaccgtcgccgagctagccaacgagtaccacaacacccagcccgcctacacctacctagctaaaggccagaacatccccaacgtcgccaaggcagccgtcagcatcgaaactgattatctgaggctggccaccgagatcagcgaccgcatgttcaccagcgacgagcaggagcctgatcatgactgacgatccgactccatccgagcagaacaaccccaccagcgacgacatgcgcttggccgaagaatgggccaacagcggccgcacagtgggagccctgccgcgccgtcaacggcctcagcgacccacaccccgcaccaccagccaaccccctgtctcgtcccctgacacaccggctccgaaaaaaccccagaagacccccaccagccagcctggccgtcaacggatcaacgtcaccgtctacgttgtgcccgaactccatgagcggctgcgctcccgatcggcggcgacgggggtgacggtctcggatctggtggtgcatgcgttagcgttcgtcgccgatcatgcgggggaggcgatcgccgatgatctgcgcgtcgagacgggccccggcatgggggccggactgttcgatgtgaccccatcgcggccagtaggggtcgccaaaacccagctgggggtgcgaatgacccgccacaacaaggatggtttggaccagctgacccggacgagtggagcccgtgaccgcagccatcttgtgtctgtcgccgtgcgcgactatctcgactccaaccctgtaaagaaaggccgacatgtccgctgatgaaactcctgccgcccggggtgggcgacgctttgatacgaccgtcaagcccaggcgccgtcccatgcttatcgccgccggtatcgccatcgtgatagtcggcgcgctcctcatcactcagttgattcgctccgcccaaaccgagcatcgcgtgctggaagtccacgccgatgtggctcgcggcgaggtcatccgtgacaccgatctggtatcggtgactgtcggccaggtcgacaacgtatcaacggttcccgcagaccagctcgactcactggtcggcaaacgcgccacggcagatcttcgagccggatcactcttgcctgctggggctatcggcccggccgatgtcgttccagctccgggcaagtcgctggtcgggctgaagctagccgccggacagatccctatcggagaccttgctgccgggacgaagctgcgcctgatccagacgtcggcacccagcggctcatccaccaccactgatagcagcaccaataccgatggccagtcgtgggaggcaacaatggcgaccggcaccaaaaagaccgagcaggtcaccttgatcaacgccgaagtgaactcgcgtgatgccgcccggatcgcccaactgacgtcacagggccgtatcgccgtagtgaaggatccgatccgatgagcaccattgttttgaccagcgtctcgggagccccaggggtcaccacgacagcgatcgggctgggcagggtctggccacaatcgagcctggtcgtcgaggatgacacccaccacgccatgctggcgggctacctgcgagcctcccagcacgccgaaccgaacctggccgcagtggcgaacctgacgtcgactccaaccaacgcccaaacggtgtgggaatctatcgccagacccctacccaccgatgacccagtcggcgggctgcgacgcaaaggcatcctcggcccgcccacgccgtggtctcgcgcaggcatcgacccccgatggggattcatgctggccctgtggcggcaactggaggaggctggcatcgacaccatcatcgatttgggtcgcctagccacaccactgacctcaacgccacacctgatcgccgcacccatcgtcgaggacgccgacatgatcttggtgatgatcgaggcgacactacgcgacatcgccggcgcccgcacgatggtggagggactcgctgagcagatgaacttggccggcgcctaccgacgtctcggactgcttgtccaccgtggcggccaggcccgcggcgtcgccgagttcaatgacaaggagatcacctcggcgttacgactcccggtcatcggggccattacccacgacccggccggagccgcccaactctccgacggggtcgggcagcggttcgacaagtcacgtctggcccactcactatcaaaggtggcggccagcctcgtcgatgccataaacaagcgccacgctgatgacgaggaggatctgtgatggccagttttgctgataatccgttcgacaagctgcgctcccaggatgcggcaagagcttcggtagagcaggagcctgatgccggattagcgtcggagttgttttcgacgtcgtcggggtgggccagctctcagcaggtgtcccaagctcaaccggtgatgacccgttcggagaacgtggattggccggttgtcgcggagctagccagtacggccactgatgaggttgaggctgagatcagcaggtggagttccactcatgatggggtggcgacgctagacattcgccaggccatcgcggagcctgctattgcctcggcggtgtctacgtatgctgaccgacgccagatcgatgtaggggagacctggcctgatctggtacgccagcgataccgcaaggctgtgtgggatcagctgttcgggatggggcggttgcagccgctgttcgaaatcagcgacgccgaaaacatcatcgtggtgggtaaccatgaggtggttgtcgaccacaacgatggttcccggtcaacgctgccgccggtggccgactcggatgccgagctggaatcccagatcgcccggatggcgaggaatgcgaccccgcggcgagccttcgacgccgatcacaccgatgtgacgatcatgcaccaacagaagttccgtatccacgcgatctcttcggaggtgtcgttgcaaccgtcggtggtcatccgccaacatttgctcacccaaatcagtctgggggacctgtcccagcggggaatgatgccggtggaagtggcccggttcctcgatgaggcggtacaagctggcaagtccatcgtggtcgccggcgagcagggggcaggcaagacgacgtttttacgagcgttgatccacgccattccgatgcgggagcggttcgccacgttggagaccgatcaggagttgttcgctcatctgatgcctggccgggaaaacacgctggtgctgttcgcccgtgatggtaacggcgaggtggatccggcgactggcacccagcacggcgctatcgagatcgcccagctgattcctcctagcctgcgccaggcgttaactagggtcattgtcggtgaggtgcgcggcaatgaggcttcggccatgttccaggctatgcagtcggggactggcactatgagcagtatccactccccgcgagcctctgaggtgccgtcccggctagcccaaatgatttcgatgggcccggtctacgatctggatcaggccatgctgcagatcggtcattcgatcgactacatcgtctttgttcgtaagcgtgacctgcctgatgggagccggctgcgatttgttgagcagatccgttcagtctcgcctggtgattcgacaactcccagtcttggcgaggtgtacacggctgactcgtggacaggccagccgcttacgccactcatgcctggttcggccgccgacgagctgtctcacttcgcccgagacctggattactgcgaggcccactcatgaacactcccgcactaaccagcgccctcatcgtgaccgggttggggctgatcctggccatcgacgggctggtcccggcgccgcctcgacctggtgccccgctgagcccggcccagaggtgggctcggctcacccaccgtcccacaggagcggccgggcgtcgccgggatttgcgttgggggttggctgttctcgtcggcgtcgtgctgtttatgctcaccgggtgggtggctgcgctggcgttgggccccatcattgtgttgttggcccccaccctgctgggggcggccccaccgaccgatattccgctgatggaggcgttggatcggtgggtgcgtcaggtcgctgcggtgctgccacaggggcgagacatcatcacagcggtgcggatctcacggccgcgggccccgaagctgatcgccgggtcggtggatcaactggtgtcccggttggatggccgtatggagccgagggaggcgttccagcggatggccgacgagctggactcggctgaggctgacgcggtgctggcctcactagcgttggcggccactcatccgcggggagcctcgacaacgttgaaggctattgctggcaacatccaacagcggttgaaagtgctgcggcaagtggaggctgagcggtctaagccgcgtaactcggtgcgccagatcacactggtcacgatcgccatgttcggggggctgctcgtgatcggacggtcgtttctggccccgctggcgacccctcccggtcaggtgctggtggccgtggcggtggtcatgtatgtcatcgcactagtgcagatgtatcggatggcgcggccccgtcgacgcacccggatcatggtcaggaggacccgatgaccattactgctttgtccctgctggccggggccatcgtcactgtcggactgctggtcatcgtggcagcgttccgcccagccccaggccctgacctggttgccgctctggaggtggtgtcgggtcgcacctcaagcgtcgccgagaacgtcgaccagacccggatcgggcggataggtcgcagcgtgacccgcacattccatgtgtcggtgtccccggccatgcgggccgcactgcgactccaaggcacgacccccgaagcgttctacggtcgacgcctgatctgcgcactgatcggggcgatcctgccgtggctgctcaacgcggtagccatcgcggtaggggcgaattccccgaacctactcatcccttcggcgctgtgtgtggcgttagctggcgctggatggatgctgccggcagcacggttgaaggctgcggccgggcccaccaacgatgactcgttcgaagcgctgctggtattcatcgatttggtcgtgctggaacggctcgccaacgaaacctccgtcgacgcgctcaccaatgcggcaaacatgtcggactcgccgctattcgtccagatccgtcaagtcctcaaccgtgcctccctggaaaacgtcgacccgtggaacgggctagaccggctagccgaggacatcaaactgcccgaactcaccgatgtggtctccatcgcccgcctccaaaacgaaggcgcctccctcgtcgacagtttccgggcccgagtcgccgagttgcgcgacgcctacctgctgcgcctgcaacaagaatccaccgccatcacccagcggcttggtttgtggacgatcctgcaagccggctcggtcatgctcatcttgctgggggcggccgccctcacactcatcacagccggataaaccgacatcgtgtcgagcccccatatgggccgcgaacctttcataatgatgcctgtaagcaccacaatattgatcacaacctaacaatgaaggagaaatcatgatgaccgatctcgacctggctaaaaaacagatcacctggctggcggcgcacctgcgttcccggatcgttgacgagcgtggcggtggtagctctaccgtggagacactgatttggattggtgtcatcgtggcgctggtgattggtgtgggcgtcggggtgacggcctatatcaggtcgaagatgcctcactgacgacgatgcgtagcaggttcacaactgatcagcgtggcggtggtagcgcgtcggtggggatgctcctgctgatgcctgcgatcatgctgctggcattcggtgggatcgaggtcgggatgtggtgtcacgcccatcagtcgaccatcgcggcagcccaaagcgccgcggaggctcagcgtgtcgtccatccggtcccggggtcggcacaggaggcagcctcgcagatcactagtcatggcggggtgcgtgatacccggatatcggtcagtgatgacggggccactgtcacggtgaccgtctcaggtcgggccccatcgatgctggggctgcatcttccggctgtgtcgtcgacagcgtcgatgcccaaggagcgcctgtcgtgaggcgaagtgagcgcggtggagcaagtctaagcgtcgaggtgctcatgtgggcgccgatcgcgctggtgatcatcgggtttgttgtgggtatcggccggatgtcgatggcccaggacgcggtgaatggcgcggcgggtgctgcggcccgtgcggcgtcgttggagcgtgatggacagtcggctcagtctgcggcgcagcaggcggcgtcggcgaacctgtcgtccggtgggctggcatgtgcgccgagtgtgagcgtggacacgtcagtgtttgcccgtcctgccgggcaggcgggcacggttcacgccacggtcacgtgtgtcacctcgctgggtcttgggttcgggtcccggacggtgcacgcaacggggtctgccccggtagacacctatcgggaaaggagaggctgagatggcccgtgatgagcgtggtggcggctcggtgtcggtgtggatgctgctcatggtgccggtgattctggtcatggccggcctggtttttgacgggtcccgtcagatatcggcaacccaggcggcccaggacgcggcggttgcggcatcccgcgccggaactgatgcggcagcgacaccgcagcttgctggccacgacggggcggccgtagcagtccaagcggcccgccaggcactatctgctgccggggtggacgggtcggtgcaggaggacgggtcgaccatcacggtgaccacgtctcaaagtcggccgacagtgttcctgtcagcgatcggaatcagccaggtaagggggcatgggcaggcccatgctcagcttgtgggaccgggagaacgcccatgacagtgatacgtcgtatcggtgccctggtggcactgctggtggtgatagccggcttaccggccgggctcgtggccgcaggcgccccgctagtaccctcgggcctgtcatgggcccatgtgcggcatctgttggttaccccagacatgaccgggtcggtgctggtgtggctggtcagcctcatcggctggatcgggtgggcatggttcgccctggccgtcgcagccgaagcggtgacgatgctctcagggcagcggctgcactggcacatgcccggccctcgcctagtgcgccgagtggcagccggtcttctcattgccgcgttcgcggccgcaccggcagccacaagcacggctcacgccgccgaggccacccatgtggcggtcgccgcccaggctggaccggcacacgcggcccccgcccaggacagccccgccaccacctctcaggccccggacgcctccaccactccgaaaatctggaagacctacacggtgcgggccaacgactacctgtggaagatcgccgagcactactacggtgacggcgcccaattccgtcgtatcgccgaagcctccggtatcgacccgcactcagagctgaaagtcggccagaaactgatcctgccggttcccgagaacacggccgcagttcattcggttaaagcgggggagtatctgtgggagatcgccgagcactactacggtgacggcgcccagtaccataaaatcgctgaagcttccggtatcgatgcccattccgatctagccgtgggccaaaaactcgtcatccccgggcccctccgccacgacgccacgccgccacaccactcggcgtcgacccacgcgaaggccgccaccccagcccacacgcccacgcgacggcctgcgcctgcccacaaagccacgcccgccccgacgccggccaccccaactactccgacccacacggtgaccccagctccggcctctgccggccactcgaccagcgacgagcacccactccatacggataccgccgcagcggacaaggccagcaacgaggacgccctgtccccaatccaggtgggtttgaccgccagcgtcggactggtgctggtcgccggactgatcaccaccctcaaccgccgctaccggacccggttcacccgccagccccgcggcaaggccatgaccctgcccagcccggacgcccaaactgccgagatagcgctgcgcagcaccggggcgactgacactctgacgatcacctgcctcgaccaggcgctccgcgcgatcggcgcatggtgccaccactgcgggcacccgctgccacccctgctggccgcccgcgtcgatgacgaccggatcgacctgctgctatcccaggcggcccccgaccatcccgaggcggtggagctggccgccgacggatcggtgtggaccctcaccgccgaccggatcgacgacctgctagcccacaccgatgacaaccaagcggctccgtggccgtctctggtcacactgggacgcgacgacgacggcgcccacatcctcatcgacttggaagccgcaggaaccttgcacctgatcgccgatgacgaccaggtcgacgcggccctcgccgcgatcgccgtggaactggccacctgcgactggtccgacgaagtcaacgtcaccctcgtcggccaggtgtgcccgggcctagaagacgcactagagtctccgaccctgacccgcgccaccgacgtggacaccctcctcaccaccctagaagctcgcgccgacgaccagcgacacatcctcaccgaaggaaaccccctcgccgctcaccgagccgaccccgccatctccgacgggttcgacgccgaagtgatcctcctcgacaccgaactcaccgaagaccaccgcaaccgcctcgccagcctcgtcgaggctcttccccgcgtgtcagtcgccgcggtaacaaccagccccaccagcccagacgaatggtccctcaccctgacaggtgacccactagccgccgacctggctcccctcggctggcacatccacccccaaaccctctcccccgacctgtacaaccgcatggttgaactactcgccaactccgccgccgcagactacgaacccgccagctggtggaaccacgacgccgacgacgagcccaccaccgaccccaccaacgaggaagaatctaccccgagcaggcgagcccgcccgaatatccgcctgaccaccctgaccggcggcatcgacctatccagcgtcgacatcgacgacatcatcgacgaagccaaccaggccctcgacaacaccgaccagaccaccaaccaggttcgcgtcgacaccgaccaacccggcaccgacacccccttccccatcgacgacatcgacccgctgagctccgaccacccggtcctatccatcatcggccaccccgacatcacaggtgccactggaaccgttgggcgctccccgtggcgctgccaacagttggccctctacatcgctgagcatccgggagcatcgggggcgactatcgccgatgatttggggctatcagcgtcgacggtgcgctcgattgctacacacctgcgacactggttgggagccgacgatgccggggtggcttacatgccggcggcgacgcgcggctaccggctcgatgagcggatcgtcacagatgtggacctgatcgacgctgctgtggccggggcaggcattaacaccgctgagacggccacactggtggccattttgaagctgggccgcggacgggtcttcgctggggttcctgactcggaacttcgccagttcagggcgtcgatgtaccacgtggaggcccgcatcgtcgatgctgccctccaagtgacagaccgggccctggaagccggagacttggggctggcccggtgggcgctgacccaagggctactggtgtctcccgatcatgaggacctggtcgccggttgtctgcgcaccgaataccaggccggcaacatggacaaggtcgccgagctagttgatcacctgtcggctaccgcacgccgactgggcgtcgacctcaacgaggacaccacccggatcatcgatacggtcacccacgccgacaggagagcatcatgatctcccctgcactcatctccgtcaggaaggtccctatgcaccattatcgtcttggtatcggcactgccctcatcgccgtagcagccctcaccggctgccactcagcaggatcaacgtcggctcccacgccgacaccgagtacccccaccacaacatcgacagcatcggcgagccgcacttctagcccgaagccatcggcgggggccgtcagtgccgccgaagccgaaaaggtctaccgcaccatccacaaaaatgacttcgagttggagaagatgggaggcctagcccccaaccagccggccccactcatgatcaccaactacgcctccggccaggccctcaagagttacacgacgttcaaccacaaggtctacgacctaggcatccactggaagtcagggacctcaaccatcacggccgtacgcgagaagaccggcgatacgactcatcccgaagcggctatcgccctggaatcatgcgaggaccacagctccgtccgaaccgtggaccgcaatggaaaagccagccatggagtcatcatccatctcgatagttggtatgcccgcgacaaggcaggcaccgtcaagatgatcgcacgtaacggagtggaggttccctcatgcgacgtcaagtaatcaccgccggccttctgggcctggctatgaccaccacggcactccccgccctcgccgatagaggcggtatggatggaaaagtggacactgagggtcccgggtacgacgtttcggtagacgtgtggaatcattcccaccgcggcagcacaccccaccacggggactcgggtcatcgggataaaaagcctcaccgcgatgaccatgaagccacagccattgacggaatgtctgagtctgatgcctgggctgttgaccatgggtatggctcagcagacagctatgcgtgccgaatgatgaagtcatacctggacggggcaggatcggcagctctgtccccggcagagcgtaagagccagaccgatgacttcacgaaaaaatgcaaggcagacccgtcgggtaaagctgccccgcctgacccggcccaggtgggccggcacgcggccatgaagatggtcctgcctggggcccgaccagtcattgcccctgacccgagtctgaaccggtggcattcggcggcggtgggccaggccttgtggttgtccgtgaatgacccgactgctaccaagcgtgaatcgttgacgttcatgggtcaggctgtgtctctgacggctcgacgtaacgggctgtcgttcgagatgggtgatggtcacactgtgcattgtgatgccacaaccccgtggtcgccgtctgtggagccaggatccccgtccccgacatgcgggtacacctaccagcaggcagccccggaaggcggttatcaggtcaccgcaatcacgtcgtgggatgtgacctggtcggtactaggacacacgggcacggtccatatcgagaaggccggtgggcagatgcttccggtcggcgagttggagtctgttgttacacggcgatgactcctgatagtccgacgctgtatgaggtgttgggggtgtgccctgatgccactgatgaccagatcaagacggcgtggcgtcgtgccgcgaaagcgacccaccccgatgccggcggcgacccccaggcgttcacggccgcccagcacgcctgggaagtgttgtctgacccggactcccgcgcctcctatgatgccgccctagcgggggaggatgatcccgacgtagaggccccagacaacaccgtcgaccccttgaccccctcgtggtcgtggagtgtctccttcatcgatgccaccccgcggctacgccacacccggcccggcacgctcgccgcgatcgtggtagccgccgccggggtcgaggccgggatcggctggcatgaggcgttggaggccctcgccccctctcccgggttcgtaggttcgtggtggatgacctcggttccgctcgtggccggagtgacatggctcgcggcgatcacggggatccaggccatcatggccgggatcggctggctggggtggggctttatcggtgccgcctgcctgtggggacacccgtgggctgtggccgtattgggagccggatgggtggcctgggtagccgccgcagtgtggtggtggcgccgacggatggcctggcctgcccgcacctgccgggcaggaaacatggtcgacatgcccgaggttgacccgccatggatggagccggtggaactggtagcagaactcatcccctccgtgcgggccatgtggtctcctgacgggcaaacggtggctgtagtagccggtcggcgggtagcaaccttagggatgccgatgcgagggtggcgtggcatcgatatgcggggctggaacccgatcggtgccgacaccgcgtggatcgttgaccagataggcggctggctggccgaccaagacaaaccgctcaccatcgacgggcgcatcttgtacgagacctgggacaggctacagacagttcgtcctcacagctgagaaaaattttgggtccgccctgcatatcggggcctcttcataccttcaaaagtgtgaagggaatacagactcttcgactggaattaaaatggtatatggcgtgtccggtccgcacccagctccacgatgcgccatagaggagccataacttcaccaatcgtatacgatatgagtgtaggtgagcatctaccggtggccgacagtcagatacaagcatgggcggatgaagcagaagctgattatgacctcagcatgcttccgccgtctcgacgtggtcgcccaccggtggggaggggcccgggcactgtggtccctgtgcgcttcgacgcggacactctcaaggcgttgtcacaacgagcccctgacgaaggattgaccacgcgttctgacgcgatccgtgctgcggttaaccagtggctcggcctcggctcgtaaacattatcggcgcgacaaccttactgatgacgctgttggttacgccgtagagcacatcttgtactcgtgggcgctcgacgatgccgatgatcctcgttgctggatgatgattcggtgttgacccagctggcctcctcatggagctagttatcctcatctacgacgatggctatgaactcctgatccacgccatgaaagcccgccctcagtatctgagctacttcgctatctagtgttgttgggcgagttgaactcaacttttctccgacgcaagcgccaataaaaggctgatccatccgaataccaccaaacacggctgaagtgtggaacagattcagcaagacagggtgcggtgctcgggtgcgttggggagatgaggatattcaggcttctggcgggatgtggcttgatgacgtccaggatcaccggttcggttttgaaggtgccttgcattaatgtcgacagggtcgtacgactcgaggactggatcgaccagcccgttgcgtctgaagaacttcatccaccccggtggagctccggccgcgtactggtgcaacggatcattagcatgggtagcgtgagtatgccttcgatcgtggtcagtgctgtcatcatccaagattctgacgggcggcttctcactgtccgtaaacgaggcgccgaggcattcatgctgccaggcggcaagccggagcccggcgaggactcgcgtcaggcagtagtccgggaagtgcacgaagagctcggcgtcgcattgtcttccgacgacctgcgtcgggtgggagtgttcaccacgcgagcagcgaatgaggccggccatcaggtggtggcgacgattttcacccacaccccggttgcggtgagtgagccagctgctgagatcgagcagattcgttggctcgattggaatgtcgacgccctgcctgatgacctggccccgctgctggtcgaggcagtcatcccgtggctgcggcgccgtatccggtcggtcgctgtattcacgggtgcgaaggatggaaccgaccctcattatcgtgtcgaagcaaccgccttgggccggggtctcgcacacgccgggatcaccctggtttatggcggcgggaaggtcgggatgatgggtgctgttgctgatgcggccctcgctgctggcggcgctgtgatcggagtgatgccgcagcacttggtggacggggagatcgcccatcctagtctgactcacctcgaggtagtgcggactatgcatgagcgcaagcagcggatgagtgacctagctgacgcgttcgtcgcgctacccggcggcggcggaacccttgacgagctattcgaagcatggacatggcagcagctcggtgtacacagcaaacccgtggccttgtacgactcgaccttctgggcaccgctgaccgcgctactcaaccacatgaccatcgaaggcttcatccgccctgaggaccgcgcctcgctcgtgatcgccgataccatacatcagctgatggccgatcttgagggatggaccccaccaccaccgaagtggcgctcgtgacatagaacaaatgattctgactatggctcattgacatctgcgcagcggctactagctccattgacttcaaatcgggccttggccgaggctcggttcaggtggcccggaatggatccccacaaattgaatgctcatgatcgaggtgatgaacgcccactctattgtcctacgcccggttgtatccagcgagcaattgaaggtgctgcgcctgttggtcgaccaggccgagccactcactattgacgggaaagtcctgttcgagacctgggacgggctgcaggcagcccgtcctcacagctgagaaaaaattttgggggccgttccgcacatcgcggctctctttcacaccttcaagggtatgaaggaagtacagacaccaaaccgagctgagaactgtgcagtacggtgtgttgagccgcatatcacccatcggatgggccataatgatctctatgaggtctccccgcaagccataccagaagatccgtcgcggcccgaagccacgctgcgaagagcccgtcaggtccttgacgtgttatgtgcctcagtctctgatagatccgatcgacgagatggcgtggcagttggagatttcgaagtccgatctcgtggggtggtcggctttgtgcaccctcaatgtggtgcgcagggaccgaggcgaggaccccataccgatcccggagtatctggacaaggccgtgctcactgcgttgtatcccgatgggttgcccttcgacgaggacaccgaggagccgggcgagaatgccgggcaggaggagcttgcgatgactggatgagcccgaacatggttgaaggccgccccgccaggcgaccttcaatcaatggtttcggttgtcagctgcagccacccttgccaggtgctgtggttcttctccagaggaggagggaccgccatgaagacccagaagatctagaagatccaaaagaaccggtttcggctgttgcttcggtcttcatggtagctgatagcccgcgtcgttggaagtgcgacgacgccgatcctcatcggtatcgcaccctgttccagggtcgagaatgtgaaggattaacaaccatgacaagtcatgagacgccctccctgagggcgtcatgaccgctttaattcaagctctgccgacagctgaactgtctgctggacctggtgctagcagtccagctagaccctctgctgagggcttcatcaagattcatcacgaccttattagtgcgggcgtgtcgggtaacgcgatggcgttgttcgtcgcgttacgtaaccagcccggctgtgatcagtggacccgtcactcgtacctgcggctagcccaatggtgcggctgggatgggctgtcggaggcggcgggctgtaagcgggtgcagcgggccgctgctgagctcgctagcggtggttggctggaatcgcgggtcggccatgatcgtcgcaccgctaagacgctggtgtggcatcggttgaccagccccgacaccgaccgctgggagcaattgccgcggattgtgtgggcgaggatctgccagatcgccggggagacgtcgggagagtgggtgaggcattggctggtgtggcggatgctggccggtcgtactggtgtggctcaggcccctacgtccatcgtggctcggttcctgggctgttcttcgcgccaggtctctcatatccgtggggctctcgttgatgccggtctgctcggctgtgacgaggtctcgggggcggcgagccgggtgtggttcccctcgatggccgaggagtgtgcagcggatcgtgaggtggtcgatggggccgtcgtcgatgctgaggtgggctctggtgaaggtgtcgaggagggcggggaacccctgtcgattttgtccacccacccctgtcgattttgtccacccacccctgtcgattttgtccgccaagtattagacaaaccattagacagtgaattagaccctgggtcgcgtcagcgtgttagctcaccgccgcgcgcgcgcgcggcggccgagccgccgaagccaaagaaacccacaccaccaacgcctgaaccagcagcccccgcttcagacagtcctgtgtcagcgcacgctgatgaggctgccaagttggcgtggcagttcgtggggtggtgtcctcagctggtaggggcaccgaagaaggtacgtggccagctccgtcagctggtcgctgccgagatccgccggaatccgggctggctggatgcgccagcgttggaggttgttgcccagcgggtacgtgctgaaggtgcgctgggggtccagcactgcgagattgtgcgagccgagctgcacggggtgatcgccgaccagaaggccgcccccgcccgccccgacgccctgcacgcgcgggagcccaagtggtgggacgacgtgtactacgaaggaaacacaaccgtgtggacgtacgactctgacgaaaccagtgacgacgacgaggcgtggaaccggtcgcaggtatgtcatgttgctgagcgtgacgacatggctggcgggattgctaccaacctgctggcctcccacgctgatgatccgatggcctggctgactcgccgtcaaaccatgctgatggctcgtttcccccacgcccagaacgaggtcaccgcgatgtgccaaatcgtgcgcaccgccctggaggccgacctggccgccggaacccggtgggaggaccgatgagggcgctacgtcgaaagatcatggtcgtggtggctgtgttcaccgtcgcggtagcggggctggcgttggccaggtcgttgccgtttgccgacaggtctcagccgccgacgaccagaaatgccacccaggcggccgcaaccggtgcgggggctgcggcgggcgcgctcaaccgtctgccagtcaaaggcaaagcagcgatgaccggatacacccggacccaattcgggcaggcgtggaccgatgacaccgaccgggagttgacccgcccctggggtcacaacggatgcgacacccgcgacgatgcccttgcccgcgacctggtcgaggcccacctgaaacccggatcacgatgcgtggtcgtctccgggcgcctccacgacccctacaccgggtccacactcgcctggcggcgcggccggcacacctcgacaacagtccaaatcgaccacgtcgtagccctcgggaacgcctgggtcaccggggcccaacacctcccggcaccgacgcggcgcgctcttgcgaacgacccactgaacctggtggccgtcgacgggcctgccaacgaagctaaacgcgacggggacgcagccacctggctaccgcctaacaaggcctaccggtgcgactacgtggcccgccagatcgcagtcaaaacgaaataccagctatgggtcacccccgcagaaaaaaccgctatggcgcgggtactagaccgctgtccagcccagacacttcctaccggagccccacgatgaccacccattggatccccgaacaactcctagaacccggagtcggagtcatcctcgacaccgaaaccaccgacctggacgggcgcatcatcgaaatatcgatcattgacgcagccaccgggacggtcctgatggaccaactcatcaacccttccagcccagcaccacccactacaccgacacgatccacgaagctgaaaccgaacctcccatccccgtccgaaacatcaacgaactcatcaaccccaccaaccatgcatgaacgcacgatcgcctaccggccagccttcctgcgcgacgtgaagcggctcaaaaacaagcactacaacatgaacacacactcaaatgggcggtaaggtcacgaagtcgacgtggctgcctcacggatggcttcggcgagctcttggggtcgactccacatgggccagtggccggttggcagatccatcgcggtgaagttggtcaggtgcgcgacggcgctgaacatcggattgcctgctgcggccagctcgaggacctggacgctgggaatggagcagcagatcaacgtggttagtacatcatggcgagcgctattggacagcgcgacccgtgcccgggccacttgcgcgggttcaggaaccgcccgtgcccggaaccggtcaaggtgctcgttgctgaggccctctaaactggcctgcttgccgagagtatcgaagtcaggaagtggcagctcagctgtttcctcaggtagatctggtgcgaaggcacctccatcgctcatgggaccggagtccacccagacgatccgatggaccaactctgggtgcctgtctacaactaggctcaccggcccgttcgcgccactgtgtcccaccaggaccgcatcgccgcccatctcgtccaggatggctgagatggcgtcagcttggtcgtcgagcgtgcgcgtagtgcgctgggtgtcctccggatcgagacctggcagcgtcagccccacggctcgactgccagcagtgttcaataactcgactacctcgtcccaagcccaggctccgagccagtaaccaggaacgaggacgataggccgatgctggtcaggtcgcgatgttgaagtcatggagacatagttgcacagtgcgcggacaagggagtggcactatttctggcatgaatttagatctgggtgtccggtgaggcgatcagaacgcctccatgtactgtccgagtgtctaggatgcagcggacacagtcgagcagctggctcacaagtttccaggtgtccttctgcccctatgagggaagtcggctgctctcgcaacctttgagggctgctctggggtcggaaccagttacagatcgttcaagttccgggaactaccgccggtcacgctgattgattcccgggcgatctcgcttctgacgacagtggtcggtgaccgagaggagtcctactctgaccccgctgctgcggtgagtaaatcacgggcgtcccggatccggccacccgtccaagtgccagccagcttgatcggctaggcatcgtcaaggagcgacgatgaggtgatgatgcgatgtgagcgcaccgcgaagtgaggtataaagaagccttcccgggcgcatgcgtcgcccaggaaggccaggttggcccctggacggctgaatggttgggcggatcagactgtagcggagacgtgcagtacctcgtaggcgatggcgttggttgggctctggtctgcatcgtggctactgagttcgacgaggatgacggtccaggtggtgatgtcgacggcggtgacgcgggcgatggtggaatcagtggatgctgcaaggaagtcggcggttatgtcttcgatgcagtgggacggagcagtgctggtgggcaggggcacggtcttgacggtcaggcttcgggcagcagagtaatcggcggttccgttaacaagctggtggacggtccagtcctggatcgggtgccggccgaagtcgcgtacgatagccgagtaaccaagttcgccccagcagaactggcgcatcccctctatgtcgcgccagacgtagaagggcgcgtaggagttctggggtgcgcctttgaccttttcttggatgaggtaggccttgaactccagtccatggtagccgtccatgaggtgtccagtctggatgacgcggtcgcggatgatctgcatgtcatagtcggtgggcagggtgatctgatattgcatggcgtacatcagcggttctccttggtttcgtgggagtaggtcgtgggggtgacgggttcctgccaatcgatggttgacaagtcgtcggcggcttgttggtaggtaaggtggatcattggctgtttgagtgcagcgccatgccagtgtctctggccggcgtcgatccagatggattcgcccttggtcaggtgctggggtgcttgtccttcaatatggaccagggcaacgccgcccgtgacgtagaggccctgtcccttggggtgtgtgtgcctcagcggcaaacgtgacggcgtgggcggcacgcccggcgtcttccgtggcacgatcggccggatccatggcggcgcgcagctgctgttctgcagccaggcgtccaggtcacggcgggcagcatcgacacccagggcagcctcgacggcttcagggctacgacgctggccgggctggttgaccgcagaccactggtgccgggcgtcgtccagatcatggccggcggcgtcgatgagggcggtggtggcttcggcgcagcatcgcctgatccactccgaacgtgacaggccagctgtctcggcggcactgtcaatgcgcgccaggagagatttcatgggcgctcatctgtagcctccagataggcgttgatgtagcgcagagcctgatccgtcatgtcgatggcggctgcctcggcagacgacacaacgggctgtggatgataagaccacccaacatagacggcgaacatcaatttctcgacagctttcatgaggcccccggcggcaaccgcatccgcctcatcatccgaggagaaccacttcaggtctgaacggctgtacatagcccctaggtcctgatgtgggtcgaggtccttggaatgatggaagttcctacacacccatcgccaaagacctcaacatggacaacgctaccttcaccactccctcatctgtgaagagccagtttatgcacggtgttgaaagaggcgtcggtctacgacgaatgcgggttaatggtcttgtggtgtggggcgctgggcgatggcatcgagaacgcgtgagtgggtggcgatccattcggccgcgtcggggttgatgttgcgggcgacggtgtcgatcgctgttacgtagtgggcaagcctgcgaatctcagcttgttggtcagggtgagcgctgatgagaggctcttgatgggaggcgcggttacggacgtggcggatgagctccacgttttcctcgaagtcgcgtcggctacgccccgggtagtgaggcatacctccgttacgtaagtcagtgagagctttccatacggttgcttccaggcgcggggtgagcagaaagcgccagttgtccagtgacagactcgccacgatctgatcaggggtcgcatcgagcctcgcgcgccgcagtcgcttctcggccctgtcgacgttacgcgggaaaccaccgagccgatagctcggggattcccaccaacgccgtatgccagtatcggcgctcaggcgcacgtcaatgaagtttctcaggagtacctcgacatggctgatgtcttccaagaacgctttcgagatgcgggtgttccacacgtaccacgcatcgactggttcgatccggtagcggctgagcctggcgggtgagaaccactcctgcaacgtctcacgactcaccgtgggagcgtggtaagattgatgacgataggcctcgggaaggtcaatgccgcgaaatatcggtatacccccgaggtcattgtcttgcccaggcccctcctcgcatacttgcggggcgtcattggctgccgtcatctcgtctcttcccggtacgtggctgtccatgttcacgggcaggtacggcaatgaggttcccgcacacaaacctctaccaagcatacgctggcaagccgttgcatgagacgacgcctccgcccgccacaccaacggtcaccgccacggccacggtgaccgtgaccgtggcaccgaaacccaagccaaagcccaaggccaagccaaaggtaaaacccaaaccgaagcccaaggcccattcatgatcgcagtgcccgatacaaggtggagcggcccacaccaagctgggccgccaccttcgttttcgggacaccctcggcaacgaggcggcgagcgcgggcaagctggccctcgctcaatgccggtttccggcctcgatagcggccctgcttcttcgccaccgcgatcccctcggcctgtcgttcatggatcaacgcccgctcgaactcggccaaggcacccagcagatgcaacatgagctggctcaccggatcagcggaccccggcccatagacctgacccccaaggagccccgatctgcgccgaggcccgcaccgtccaccacatcagccccgacgatctcgcgacagcccccacgttcacccaggtgcggccccggctggaggatgtggtggccgatcgggtggtcatggcctggaacgcctcgttcgaccgggagcgaatcgaagcggaatatgccctagcgggcctggatgctccggcgtggccgtggtgctgcctgatgcgtttagaggcgtccgtgatggggtgccagtggcgtcgactagacggaccccaccggggccttggtgatgtgatcgccgcccgccgccggcttatagcgttacaagagatgcgggtcgccaggatgacgagtgaggggcaataaccaccaccccgaaaggacatagatcatgagtgagattcatttgacgggtgttcgcagcggttagagggcagtggcttcgtcgatggtggtgcgggggagttggtagaagcgggcgagggcgtcggcgtcgaggtgggggtccatggtggaggcggcgatgatggtcccgtagagggtccacgtggtttcgttgtcggtggggttgtcggcccagtgttggcggagttcggagaaggggtggtggttgaggaggaggcaggctcccatggagtagtcctcgatttcgtcggcggtgaggcggttgatgtggttgatgtcggcgaggacggcatcgaaggtgtcggcttcggtttcggttggtgcgtccatgtcaatgttcatgggggaagccctagggcgctggtgggtgttgtgggggcttgacacggatgtggtgggtatcgtgggggtgcaacttctgtgggagttgttggctttactgagagatcccccggctgtggtggctgggggatcgttgtatgtgggctggggtttcccctcgcaacacgccgatacgcatatatacagatacatcgatgtacatgtgtaatgatgtatttatgcgtagtatttctattgttaacaccaagggtggggttgggaagacgaccacggcggtctacctagcaacggccttagccgctcagtaccgagtcatcttgcttgacgccgacccgcaaggatcggcgacgtcatgggctaccgacgctttcgaagccggtgaccagttggacttcgaggtccgcccggctaatgcccccattgtcaggcgctgccgtgacatcgacgccgacctcgtcatcatcgacactccccctggtgactctcagacgattaccgcagctctcgacgtcgccgatgtggtcatcatcccgaccgagtcgggggacctggacatggatcgagcgctaatgacctaccaggtggcccacggcacgcgccgggccttgctcttcaacaaagccgattggaccaggcaataccgtgatgcccacgacggagccgccgccgtagagggtctagacgttctcgatgcgcaagttcatcggcgggtcgcctatcggcaagccatcgggacccgaccagacgacctcggagagttcgcccaggttgctgcccagatcaaggagatgctgaagtgagtaagaaccgcaaacccaccgccgcagacaaggccagccgctacagcggccagatggcggccagccagggggccagtgttgccgaaaccttccagtcagccaagaccccgattaccccgttcaacgtcaaactgcctaccgctacccatacggcgttaaaaatgaaggccgttgccgaccacaccaccatgaacgaccttttgcgcaaggccctggaacacacctacggcttcccttacgacccctaccagtgaaggacgagacaccacgccatgacctgggagcggctttagctggtggtggtgggctgggattgtaagggtgttgcggggttcgtgttggtggtgggtgttacaggtgtctagcagggtaggttggtgtacatgatgataggtgtatgagtatctatgtatctttctatcggggcttatcggtagatgtcgcggcggtgaccgatggacagggcaaggatgatgaggcggtcatcgttgagtgtgcatatgaggcgataatcaccgatccggtagcgccacagtccagaaagatcaccggtgaggggcttgccgtggcggcggggatcgtcggtgttgtcgatgtttttcgtgatccagccgtgaatgagtttttgggtgtagcggtctagctttttgaattctttatcgaaccggctagtggtttcgatctgccaagtcataggtcacactcgtcccatagctcgctgatgggacgagactggtagttgtcgttggcgtagtcggtgagtgcctcacgggctacttgcagatcgaactcgtcggcgatgcggtcgaagagggcttgcttgaaagcctcactcagggactgcgagtgtaggtgggcgtaggaatcagctaagcggcgctcatggtcggttaaacggatggaaaaactcatgatgtcacctcgtaagacgtctatagtacaatgtactacacgagggtgggggagtccactcctcgaccccgcgtagtacgtatcaggggtatggagattcaggcggcgggaacggttcccctgtcggggggtgaggggcgaccggggtgagccggtcgccccgtggggctcactgtgcggtgagctgcaacgcctcggcaatcgcgtgggaggtcttcgcgacgtgctcggcggcagcttcaatcgcggcgccgtctgcttccttcgcccagccggcaacgtacccggctgaaatgggtgcagagtccaacttcccctcaagggcaggcccgtcatgctgtcagcagatctgccagttgtgggtgctggtgtcgtagcagacgccggtgtcggtgtcgtcggtgcggttggtggcccagccggtggtggagtcgtcgagggtgatgtggtggaggtcgggttgagtgttgagccagtgagtcccctcagcttggggtaggccatcgaggatggctagcaggtgggagatggtggctgtgcgggtgagcgtgaggatggttttggatgtgttggtggtgtcgatggtgaagccgtagtcggcgagtgcagcggtcacatcggtgggctggtcggtgtagatgcggttggtgagtacggagcagtcggggccttcgccgtagatgctgatctccacgctggtgccgtggtagtgggcttcgtaggtttcgtcgatcatccatgttgtggcccagtcggcgtcgacgagggtgtagggggttcgggtagtgggaagtccgatgtagggcttggtcaccatgttgacgtgtgcggtgtacttcatcgtcgttgattcctttcccgatctctcgttctgcttataaatatatagcccgatagacagactgtcaagagtactggataaataatctaatacgcttgacttgaaggatagttgagagaataactcacatgtgagatgccatcagcggcgcagaatgccccctcctggccccttgccgccccttcgggtggccaaggctgtaaaccgcagcgatacaggcttacaggtgccccgaaggggcgcctatccacgcgctcacccgacgccgaaggcgtcggcaggccctgcccgaagggcagcggctgcccccc

SEQ ID NO: 188 - DNA, 53136 bp, Propionibacterium acnes
ggtgagcgcgtggataggcgccccttcggggcacctgtaagcctgtattgctgcggtttacagccttggccacccaaaggggcggcaaggggccaggagggggcattctgcgccgctgatggcatctcacatgtgagttattctctcaactatcctttaagtcaagcgtattagattatttatccagtactcttgacagtctgtctatcgggctatatatttataagcagaacgagagaccgggaaaggaatcaacgatgaagtacaccgcacacgtcaacatggtgaccaagccctacatcggacttcccactacccgaaccccctacaccctcgtcgacgccgactgggccacaacatggatgatcgacgaaacctacgaagcccactaccacggcaccagcgtggagatcagcatctacggcgaaggccccaactgctccgtactcaccaaccgcatctacaccgaccagcccaccgatgtgaccgctgcactcgccaactacggcttcaccatcgacaccaccaacacatccaaaaccatcctcacgctcacccgcacagccaccatctcccacctgctagccatcctcgatggcctaccccaagctgaggggactcactggctcaacactcaacccgacctccaccacatcaccctcgacgactccaccaccggctgggccaccaaccgcaccgacgacaccgacaccggcgtctgctacgacaccagcacccacaactggcagatctgctgacagcatgacgggcctgcccttgaagggttggactctgcacccatttcagccgggtacgttgccggctgggcgaaggaagcagacggcgccgcgattgaagctgccgccgagcacgtcgcgaagacctcccacgcgattgccgaggcgttgcagctcaccgcacagtgagccccacggggcgaccggctcaccccggtcgcccctcaccccccgacaggggaaccgttcccgccgcctgaatctccatacccctgatacgtactacgcggggtcgaggagtggactcccccgccctgagcagtacactgtactacacagtcattgaggatagaggtgacgtcatgagtttttcgatccgtttaaccgaccatgagcgccgcttagcggactcctacgcccgcctacactcacaatccctgagcgaggctttcaagcaagccctcttcgaccgcatcgccgacgagttcgaccttcagatagcacacgacgcactcaccgactacgccaacgacaactaccagtctcgtcccatcagcgagctatgggacgagtgtgacctatgagctggcagatcgaaaccactagccggttcgataaagaattcaaaaagctagaccgctacactcaaaaactcattcacggctggatcacgaaaaacatcgacaacaccgacgatccccgccgccacggcaagcccctcaccggtgatctttccggactgtggcgctaccgcatcggcgactaccgcctcatatgcacactcaacgataaccgcctcatcatcctcgccctgtccatcggtcaccgccgcgacatctaccgataagcccacaccacccccaaccaccaccaacccggtgcataaatacacatacagctatacacctatcatcatgtgcaccaacctaccctgctagacacctgtaacacccaccaccaccagctaaaaccgctcccaggtcatggcgtggtgtctcgtccttcactggtaggggtcgtaggggaagccgtaagtgtgttccagggccttgcgcaaaaggtcgttcatagttgtgtgttcggcgacggccctcatcttcagcgccgtgtgggtagcggtaggtagcttgacgttgaacgcggtgaggggggtcttggccgactggaaagtttcggcaacactggccccctggcttgccgccatccgaccggtgtaacggctggccttgtctgcggcggtgggtttgcggttcttactcacttcagcatctcctggatctgggcagcaacctgggcgaactctcctagatctgttggccgggtcccgatggcttgccgataggcgacccgccgatgaacttccgcgtcgagaatgtcaaggccctctacggcggcggccccgtcgtgggcgtcacggtattgcctggtccaatcggctttgttgaagagcaaggcccggcgcgtgccgtgggccacctggtaggtcatcaaggcccgatccatgtccaggtcccccgactcggtcgggataatgaccacatcggcgacgtcgagggctgcggtaaccgtctgagagtcaccggggggagtgtcgatgatgacgaggtcggcgtcgatgtcacggcagcgcctgacaatgggggcattagccgggcggacctcgaagtccaactggtcaccggcttcgaaagcgtcggtagcccatgacgtcgccgatccttgcgggtcggcatccaacaagacgacccgatcctggcaagacagggccgtggccaggtagaccgccgtggtcgttttcccgaccccgcccttagtgttgacgatagaaataatacgcaccataaatacatcattacacatgtgcatctatgcatcagtacacatatgtaccggcgtgtcgcggcaggaaaaccacccacatacaacgatcccccagccaccaccaactccgagatcttatgaagagacaactcccacaggagctacacccctcacaggagcccaccagatccgtgtcaagcccccacaccccctaccagcgccctaggcttcccccatgaacattgacatggacgcaccaaccgaaaccgaagccgacaccttcgatgccgtcctcgccgacattaaccacatcaaccgcctcaccgccgacgaaatcgagtgctactccatgggagcctgtctcctcctcctcaaccaccaccccttctccgaactccgccaacactgggccgacaaccccaccgacaacgaaaccacgtggaccctctacggggccatcatcgccgcctccaccctggacccccacctcagcatcgacgccctggcccgcctctaccagcttcccctcgacctcgtgacccaagccctcaccgtctaagcgccgataagcgggggagaggtagcgcactatcggctaaggaaccccacaaacaccaaacccttgtcactgggaagggtttggtgttatgctggtctcacaactcaacagaggaggtgagacatgggaaatgagtaccagaagtcgctcaaagtcctgttcaagaaactggaatctgagcaaggagcccgcatcgagacccggcgcaaaggatggatgatctacccgccggatacgtcacgaccagcggtcatgatccacaagactccatcagatcgcagagcatgggccaacatgctttccgaactgagacgctcaggattcaccgtctaactcagtgaagggggctggagctccagccccctttcaaccacctcccccggacaccacacaagaaaaggagaacatgatgtggcacgttcggttgtcgcttcgcgcaatcagcgaggacatgctgttcgacgccctggacaccctcgaccccttatccccggtggccacactgggccccgatgagcacaccggatcattggcggtgttcgtcgaggctgactcactgacagacgccatcgagactgcccgcacagccatcaccaacgcatgcaacaccgccaccataaccggcgtagaagcccgccccgaagacgaatgcttcgcagacgttgaccggcccctgttcccgccagtggtcggatacaccgaaatcgctgaaaccgcaggactctcacgtcagcgcatccgccagctcgcaggcaccgccgggttcccggcccctgtcatcgaaaccgcccaggggccgctgttccccaaagccgcagccgagcagtggacacgaacacgccagcccaaagcaggccgcccaaaactccagaccaccacctcataacacatcccgtgtgctgaacctgttggccggcccagcacacacccccaggggccgggcccagcccggccccgccccacacccagccgctccctgttgccgccgtggcgaaacgatcaggcgagccacgaccatcaccaagctgaacggagagcgagcatgagcaccacccctgccgggttcgatgtcgacgctctggccgagtgggctgagagtgacgaggcaacccagaccccgcaaaccagcccggtgttccacggcaaggacgccgcgcgcgccagccgcgcattcctcggccgaggacggccggcactcggctcagaccgcgctaccggccaggggcggtcacctcgccgtcaggtccgcctcgacgcacgcaccaacgcccgactcgacgcctacgcagcccagaccgtcaccagcgcctcccaggtcatccgcgacgccctcgacacctatctgcctgcctgatccaaccccaatccactcgggcgcctgtcagtgctggtgttctaggcggtggctggcatcgacggcatctgctgcaacgctataagcctctgcctggctgctatcacgtcgccgaggccccggtgtggcccgtctagtcgccgccatcggcagcccatcatggccgcttctaaacgcatcaggcagcaccacggccacgccggagcatccagccctgcgaggccatactcggcttcgatacgtccctgatcaaagggggcgttccaggccatgacgacccgatcggccaccacatcctccagccggggccacaccggtgtcctggcctccagtgtcgcgacactgtcgatttcggtacgtgcaatgcggcggcggtttgacggatcgacatcccagactcccgcgcgtcccagatcgccatgtggagagtatttgcctccagtgcggccgccacacttgcacgctctcgcgcacgctcgaatgcccgcctagtgctctcaaatgtcgtcacgacgcctccccctgaaaatactcagggtgtcccacggtgggacaccctgagtatttcataccccaactcgcctcaccacacgtcgacctcgacaccgatcaagcgacccgtatcagcgacattgccgtaccgctgccccgcctggtcctccagccacgacaacgcatcccgaaacagcccgacgtcttccaaagctaaaccacagtcgtagccgcccttgtcccccaaccgcacaatctggcgctcccggtggcctccctcgtcgacctcgatccacagtttcgcgtgcatccgctggcctcggccctctgacaggatctcggtgagcaggtcggacgcctgccctcgcgcatcctcgttactgcgggggaattggagtatgtgggaggaacgatgatgggggaggttggtgacctcatggcgcagcaggttgcgcttgtgcatctgctggtcgagacggtcgggctgacctgttgacggggttgagccgtggcgccgcttcctcggcggggtctcgatccgttgctcttccggcggttcggcgtcaggttgtggtgcgcgatctcccctaggacgggggggctcgccacctatatccgagggacgatgagacggccttccacgcttgctgcgcactttcgcagcccgccccttgcggtcacgtcgacgcggcggcggagtgacgtcctcaccgcgcgctagctgcgtcaacgccgccaccaggttggtgcccggtttcagccctttcagcacgtagcgcagcaggcgggggtctcgcttgattcgtcgagcgatctcattctggctccacccctcggccaccagggtgcgcagcagatcctgggcccggctgtcacgctcagccacggctcaccccctcagggatgcctgcctgctcggcctgctctgacagggctgctcgttccgatccggtctgcggcgcttccagagggccaggcaagacacccttgacacgcagccgaccatccttgccatcgtcgccgcccccctgggccacagagagcgcccaggtaggcacgctgctggtgtagatggcgtcgccgtgaatggccagcagacagcgagttctcaacgctcctcccctggttgtggcgtttttcccggtggcggggtcagcgatgggtgtgttgagggtgcgcacgcgcgacagagcccagatacgggcagcgatctcaggatgccaggtgtcaggatcaggacggcgacgggcagtctcgtactggtaggcgatgacgtcaccatggttgttgcggatgacctcgaaaccttcgatgtcggagggaatgtcctcagcgtcgtagacaacagtcgtggtgacggggttggaggccgacatttgcccgatggtcacgcgcagcatgttcttcaaagcggaggtgagaagcgcggtagcagtggggctcttgtctgcccaacgactctcagccatcccgatcatgtcttggatggttttgacccatcctcgaatggggtcgaccttggtcagtttgatccctgccaggaactcgatgggccgactaatgggcccgtcaggcccgaactcggtatcccacccttcgtcgatcgcaagcttcaactcggcggcatcgacccacgtctcgtacgtggcaccaggcacattgggccaaaaccatcccgctcgaccctgggtacgtttgaccggaaacaaaccgatgccatcccaccaggacggcacggtgaaacggacgtggtaacgggccggatgccaaggatcgtcagtaaacaggtcgcgggcttcggtggcgccgagcagagtcgctggtgcggcaccgatctctccggtcactgatccggcatacatgaatcggccgtcgatgtacacgaaattagggatagaaccggcgggagcagtaggccgccagccctcttcccggtcaccagagtcaccggtatcaacacacagctcgtaacggtgctgaggcgatgtgcgctggatgagtacacccaattcagggtccatcggctccatgccataagactcaggagtccgcagcttccaaaggttaatgccctcagccccagggcgatccatgagagcccaatcgcggtcaatcctggtagcgataatgtcagtcagctcccgccatgcccagcgagcctgaaccggagtgagaacctggccaggaaaccactcatcagccacaaggacatccacgttgcggtcggtctccttatgagtaaaccggcctcgcgcaggccgacccgccagcatgaacaagccccgcacgtgccaatccttgatgaactcgcgagtgtgggcaggagtatcaggcagtagccacgactgaggctgatcagggatatcaccacagacgatcagacgtcgagcgtgatggtgcagcgcagtcgtcaacaaatccgacagagtggcgcgcttagtgcgccgaccccccagcaccggcaaaatctcgttcccggccgcgtcaaccccccgagcagtgtcaatatccagccacaccgtcacaggatcaggaggccgatgaggggcaggccgacgccgctcctgaccatcactcacgacttcctcctctgagccagagaacggccagcatcaagggcattgacacgctcgcgccgctcctcacgcaactgatagacccgaccacgggacacccccgcaacctcagcaatcgtggcggccgataaatgcccaatggatgcagcatcgacaagaacctcacgccacgccaaatcaatcgctcccagctgagctagagcttcctcacggcggcgggtggcgtcggccaccacgcaggcccaccctgcagggtggatagtctccacgacgattcggccatgacggatgggtccccatgcatcagcgggtacctgccagccatgatcagccgcggactcggtgattttgagtcgtcgctcaggtgcgcgggtgcggacagtagcgtcggtggtccaggtttggactggcacccacgccccttctcgggcgcgttcgatgacgcacgtggcgccatcgtcggtaaccgtgatgaccagacggtagtccttcccgtctggagtggttcgatagctgggcatgtagccctccccccatatgtcaatctaactagacatattctctagcctatttgacacattgtcaaggacaatagacctttcgtgtgaatccaccccgtcaaatgcacactcacgcctcatggcccgccgtgacgccttaacgaacccgaaccgctcataaaaccgctccgcagcatccccagaggatttgagttccaaggtgaaaccttgctcgtcagcccattggcagacgtgggcgagaacctgtgatccgtagccctgatttcggggggcggcatgcacgcacatcagcatgtgaccatgacggcgggtcggcgggctgacataagccccaccacgccagtccggtgtgatctgccaacttcgccatgccgcagcgcgccagcggcgggcctcggtagccaccatgatcaccatgatgatggacagggctacgacgccgactatggtcagctcactccagccaggccagttcccggagatgatccagcctcccagcgcccagatgatcatggcttccacgcccgccgcaatcgggacgagtggggcagtacggatgcggcctgccatgatttcggtgatctcgctgcgatgccacgaccaagagaactcccacgaggcacgaattaggctcatgcgtgaacggcttcctcggcttcgctttgccatagcttctctagacggcgctcggctagctcgtcggggcacggcgacagcctgccgcactcggagcagaccccgaagtggcgcgagagagtgatgaccggctcatcgggggcatgcaccgattcaacgaccgggtgttgctcatcggtgagtcctgaggcgtgaccaatctcggctagacggaggtgaaccataccgtcgtagtagtcgacgccctcaacgtggaacgggtaggagccggccgaggtgtggcctgcaaccagatccccgacttccagctgactggcggtcatggaccgcaccggtggcagcggggtccgggtcgcgttgatcctcatggtcactccttgcttctgcgccttcatctatgaaggtgtcataaccggggtcgatgtgcggagccacagtcactttttcagcagatccatcatctgggacccaccccctcccaaatgtgttaaccgtgatttacactttaaggcatgatcgaacacacaccgacacccgccgcacctcgcgtggccatcatttcccctagcgggccaccacggttctcggccgagcctcccagcgccgcgctgcgacgccatggtcggacccgcatgaggtcccttcccctatcccctcacattcgcgcctgggtctccaccagcggtcgtaaacccaatcccatagccaccgccctgatctggatgcataccggagccctgctgccggtgtgggacaccgccgttttgactgggcctgccctcggcagacgtgtgcgccctctcagcagtgacgccgaactgacctctcggcggtggctcgaccaggttgccgaccatcccggctttctcgacacccttatcgaggccgcccacatcaccgagggatggcatcacgcaacacctccgcacattcaggccccttatcggacccttcatcagtgaacggaggtacaacgacatgaccagtgacattgaatggggccacagccctgatggccgcgccgaagccttgctgtaccgggcttgggccaagatgctcgtgcgcgagtccaggctgccctggcgtatcgtcgccgctctcgccggggtctcccccacctccatgcaccggcttctgttcggccgcaatggccgacccgtggcatggatcggctccgatgatgcccgcgccctgggggccaccaacatcgaagacctcacctcagcggccaccgaccggataccggcccgcgagtcccgcgaattgctggtagccctgcacacccttggctggaccaacgcgcacctgagccgctggctcaccagctccgacctcgccctggccgacactcccaaggctctctacgtcactcgactatccgcagcccgtatccaagccacctacgacatgatcgtcagccagcccgtccgccgcaccggccacgccagcacaccgcctgtctcgtccccgcaccccgctgccttatcccagcccggggtcgccgccaccaccgagatagtccagcccgccctgttcgagctggccgactacgcatgagaggttgcacacatggttgaatcgaaggacccgaccagccaccaggaggcccccttgcgtctatatcgcgctgctctcgccgacatcgacatccaggtcaccgtccgtatctggagcaccgccgatcgtggctgggtctgggcccccctcgacacctggacccctgacccgacgccgaccacaccagcccagttgtccgacgagcttcaccaccacggatgggtcaccgccgaggcccccaccaccctcaccgaggtggatgtcacccccgagaactggcaggacctcgtcgaccacgccctcgctgcccgcaaccaccaagccaaccagctgcgcgtcgccgagaacatcctcaccgacatcctcggcgacgccgccgacgccggcctgtctgtcaccgctctcgcccgcacgaccggactatcccgagtcgccgtctacaaacgcagcgccaaaaccatcgactccatgagacacgccacccaggccggcggaatcctcaccccctcctgtctcacccacgctgagagaacagcgctcggcctgcccgacgagtaacccccatctcggaagcgccacgggcaagaaggcaaagcggcagtgtcttcgaaccggtcacgaacacgcgaccctcgacagcacttaggccaagtttcctaactaagacggaccaatgggaagcatttttcccacagcaccgcacatcggccggggctagggacccttcaccagtgaaggcaccctagaaggaagacacaccatgactgctgtagccctaccggacatcgctgatctggaccgcgccgtcgacgacctcaccgatgctcttatcgctaccaccgatgccgctgagactagtactgacggcagttggtacatcgaaagcaccgtcgaggagttacgcgccgccttggctgaggttgcatcccgtggccgcgcagtaggggtcccagcatcattgctggccggcacatcgcgggcatggcaggccgggcaagtcgaactgatccaaatctcagggcagatcaccgacaacctcatcagctggctggccatccaccccgagaaggcagcatgaccgcaaacacaggaagaaacaacgcaggcgaagaaatcctcgtcttcctcgttgtcggcatcggagggatagccctactgaacaagatggtccccaagatcattggcaatctcggagcatggcttcgcgcccacggattgctcgacgctcccgggcagggcttgtttgatcttggttcgttgggatcagttagtgctgcccacctgatgatcgccgttggtgtgctgatcattgtgggcgcagtgggggcacggttcactggtcgcagggatcagtcgaggatgtaaacgatggggcaaaccgaggtattggtcacagaatcgttgtggcgcggccgcgggtgagatgggggcggcaagcagttgccagttaaggcctgtttagttgacttaagcacactatagtgggtggtatgaatctcaaggagtgggcaggagtgcgcgggatttcgtatcagaccgcgctgcggtggtatcaccgtgggcttatgcctgttcccgtgcatcgagtgggaaggctcgtgcttgttgattgtgacgagcatgggttgccgttcgagggatcgacctttgagccgacgaaaacgatcatttatgctcgggtgtcctcggcggatcagaaatccgatcttgataggcagatcgctcgagtcatgacatgggcgagcgcgaaggaattgtcggttgatggtgttgtcaccgaggttggttccggtctcgatgggcatcggaagaagttcgagaaattgttgaaggatggttctgtcaggacgattcttgtggaacatcgcgatcgattctgccgattcgggtcggaatatattgaagcggcgctctcggcacagaatcgtcgtctccttgtcgttgacgacaaggagatcgaagacgatcttgtgcaggatatgacagatgtgctcacgtccatgtgtgcgagattgtacggaaagagatcggcgaaacatcgcgcccgaaaggccgtggaaactgtcatgatcactgacggtgaagaatccgttaaggatgatcacgcatgatcactgagcccgcggccccgaaactgggcaggaatgatccagatgttgttgtccggtcctacaagtttgcgttgaaacccacgacgtcgcaggaacggaaattgcgtcagcatacgggtgcagcaaggtttgtctacaattatctcatttcccagtggcgcgacgacattcacactcgtatcgaagaaaaagaacgtggtgttcctgaggatggattgacgccgttcacgtttaagttgtctgcctatgatatgcgcaattactggaatcgcaccaagggtgagtgtgctccgtggtggccagaagtgtcgaaggagatcggcaatgatgcggcacgtcgtgcccatgattccattgagaactggcatgactccaggggcgggaagcgcaagggtagaagagtgggcttcccccggttccacaagcgcggatgccatgaatcgtgtacgttctcgaccgggacgatccgtgtcaatcctgatcgtcactcggtggcactgccccgaatcggaaccataaagactcgcgaaaatacgcgcgaattgcaacgtaaaatcgccaaaggtacggcaaggatcactcaggccacgatctctcgcgggttcaattattggcacgtctccttcaccgtgtatgaaaagaaacacattcccgaaacccacgcacattccggctctgttgccggggtggacatgggtgtgggagatcacgtcatcgttgcggcaaccccaaacggtgatgaaatcatgcgtaggggattgccgcaatcggtcaagaaggatgaagcgcgagtgcggcaccttcagcgcaaactgtcgcgtaagcatggcccggataagaggacgaaaaccacgccctcgaatcggtggattcgcgcgaacaaccaggttcgcaagtatcgcaataccatggcgaacgtacgtcgcgatcttgccgcgaaggctgctcatgggttggcgacgaattatgagaccgtcgtcatcgaggacttgaacgttcaagccatgatgacgcgcggaggcgcacacaaacgtggtctgaatcgtgcgatagcgcaggcctcgtttgctgatcttcgacggagaatcacctacaaaacgaggtggaatggcggtagaaccgtcattgccgatcggtggttcccatcatcgaaaacgtgttcggaatgtggagaagtgaaatccaagctctccttgtccgagcgtgaatacatctgccatcgttgtggtgttgtcgtggacagagacctcaatgctgcaacgaatctggcgaaattagcggcaccgaaatccggtgtcgattttcacggaaccgggagttcgccggggatgggacgtggaggctcggggaagaccagctcaccctcgggtgagctggcaccggccggtgaagcgtcaatggcccgaaaggacctgagcggccgcaaggccggcacgagataacctgaccatcagagtcagttctcatgcaacggtcagtgggcgatggctaggccgatgagggcgccgctgcacaggctgggtgcccaggggaggaatcgggtggtgtggtgtcggaaccgatcgattagggcatatagggcgatcagggtgaggccggctatgaccgtggcgtggatcgtgtcgatgccggttgctgcgaccggggctgcccacagtggtgtgatgcgcacgtcggagaagccgaagccgcctcgggagatgagccaggcgatcatccacgctgcgaagatgatggtggtagcgatgacagcacgtgttgccgcagtctggtccgagagggcggtaacggctacagccccgatccatccggcccatccggtccacgctagggctgccggtatccatgtggtgatggcgtcaatgacggcaacccatgccccgatggtggctagcagggcccacgtcggccacgtgggtgctggggcccacattgtggcggcgatcatggtgaccgcagccgcggcacagaccgcgatcaagcttcggagactgtaggtgtcgcggtaggcgattttgtcgggggtggcggtggccggttcgggcaggatgcgagtgagggagggccatcctgcggtcgcaatggtcacgacggcggcgatccacacgatctggtgcatgggtctcatcatggcccaatatcgatgggtgtgggtggccgacatggggtcagtcgtcgagaggtttgcgggcggttgtggcttcttgggtgccgaggatgagggtgccggagtcgtcgccggctgattcccagtcgacgatgacctggtcgccgtcaacgctggattcggcgatggtcacccattgcccgtccatgtcgatgagcatcccggcggccagctctgtggcggcaaccgggtggggtgggctgtagaggaggtcgatgtcgcgggcagggtcgtcgggttcttcggttacctcaggtggggtcgatctggctgtctcggtgtcgtcggccaggtcggctcccaggatgcgttcccattcggggctggttttcttgcccgctgaggccatcgtctcgtcgatctgttcgtcagtgggccacacaaatttctttttggtccaggtcgtggtgtcgggtcgcagctgatccagcagttccaggtcttgcggggagtgggccttgcgggggtcgggggtgtagaagaattggacttccttgggggctgattcgccggataggtaggtgcctcggccgcgtttgccgaacgggatgcccacgccgacgtgttcggagccgaacatcatgcgggctccgtcagcggacaggggtccggtggcggcacgcccggagaagttgtctcggatttcgccacccaggaactcggcgtcggggcgttgggtccccagatcgacgtggatacggcaggcggctgccatgcgcagcagggagccgatccagccgaaaacggggcattctccgggcatcccagagaccttgatcgttgaccaccagtttttcgcgttgccgtagaactggcggtactcgtcgatgaggaccagcacgcgggtgaagtcggtctcgcgggccccttcttcttcgatgcggcggtagcggtcctccatgagagaccacagccagtggatgagggcgacctggtcggggacggtagtggcgaccatctcgatgttgggccactcccgcaggcccaggtactcgatgcgtttagggtcgatgacgaagacgcgccagttgcggcgggcaccctcgacggcgtcgccgatcatggacaccgtttttccggtacgggtgcggccggccttgagctggtgggccatgacaccggagatgtcccagaaacaggtgttgccgtcctcgtcgacggcctgggggattttctcccagtctggggagtctgggcccggaagggccacgggtcggggcaccatcgagggcagggggtggcggcgggtgacggtgatggtgtcgtgttccaggtcgaagtcgctgcgccactggccgagcatcatcgccgaggtcaccgcggccaggcgcaattggatgttcgggctggacaaatgggcgccacgttggtggtgaatggtgaagccgtccaggttcccccgatcggttttccaggaatcgacggtgaccgccgacccatagatctgagtggctacttctttagcccgttccttgtctcggtccagatcggttttgtcagggtcaggggtcggggcgcggtattgcaggacgaaccggccggccgggatcgttgcggatgtcaccgtgaactctgccggcgaccaggcagccgcggccgcctgggtgagggccattggcatggtctcgacggcagcctcctcgggggggatggtgagggtcaggcgtcgcggatgcgtcttcttgcgattccatgtgactttctgcctcaccggcaccttcgccgccgactgaatggctaggcgagctgattcggcagtttcggtacgccggccagcgcgtagcgcccgtcgtgcgtgaaggctgcccaccacagcacagcccatacacggcagccaccagcgcggatcagcggctgctgcatagcccccggtagctagtaccgcacctgaccagccggccgcgatacttttccacgccggtttcgcgccaccaggaccagcgttatggacggtctgcttcgaggctgcggagggacgagacagcggagtgctggtcatgccgcggcctccttgtggcaggtcatttcacaggcatgccggccagcgatgatgccgtggcgcaccgccccggtagccgcatagaccgcgcacaactcaaacacggggcacccatcgcaggccgccgggttcatgctttctttgtcccacgatggtgggtcatcggtgcacggcacggccaggccatcctgttgagcggcgctgatagcggtgaataggcgcagctgggcgcgaacttggtctggggtcaggttgacggtgcgggctacacgcatggggttccttcctcttcaccagtgaaggttccctagacccggccgatgtgcggagggatttcagtgttttatcgaggtgaccagccatccggtctgcgctgcgggttcaggtaccagggtcagatgcagcatggtgtggtcggctaggggcacggcgaccaggggcccgtcggcgctcgccccggtgagggtgggagttccggccacggtggtggcgggaatctggttgggtttcgcggccatcagggagcccatgagggtcggggcggcgatctggacgagggcgactttgcgggcggcgggatcgcgggtcaaccagccgcgggtgaaggtgagcgcagccgacgtgatatcggggctcagcggggctggtgtggcggctgggtgggccgttgaggagggccatacgcgcggtagcgatggcgacatcgagcgggtcggagtggggtcaggtgtggggcttagggtccgatgtggcgatggggctaccgccccggtggtgggagacgagactggttgggggtggtgttgagggcgtgggatcagggtgaaggcagccaaactggccgggatgaggatgacggccgcgccgacacttcggagcgaggtcatgtgacgatccttcggtagctcgacgggttgccgtagatcttttccacgttgatgccactatgtgggttgtcggcgctaaccatttggcctccaccgatgtagacggccacgtggtgggcagggcttccccagaggatgaggtcgccgactttgagctggtcacgggccacagcagtgccgactttctgctggtcggcggcggtgcgagggaggctaatgccgatacgccggtacagcgccgaggtcaggcctgagcagtcgtagccgccatcggctttgccgttgccaccccacacgtaggcgtaggagttgttgtcggcgatcgatttggcccatgccacggcttcggccaggttcttcgacacaccggtctcgttagcggccccggtggcacagttgtttgacaggtgccctgtagtagtggatcccactatttgtttggccatggtttcccatttggcgtaggcatcgggcagggctgagccttgcactgcctgagctgcctgcgtcagcggcatcttctgccagtcagcgatgtcgactaaaccgggaatgtggaatccagggccgccggccgatccggggccagcgtaggtgatggtgtggcctttcaagaacgcctcggtggcgtaggcatcattgttgacctgatccagagtcccgtaccagcccggcaggatgcgctgctgaaaggggccggcgtcaccgtcaccgttagccttcgctgaggtagggtcggccccaagatctgattcttgtttggcggtcatgatagcgatgaccgctgcctgggtaggcagtttgtcacgctggaccacagtgacgatggtggtcacgagctgcttctgcctggccgtgaggcctccggcacccacagtgcctccggtgacggtacccacgcaagcatccccgccgacactgccaccgccgccgccagagttgtcgtcgagggccccagagcctactgacagcagcggcacaatgatcacggtcgctggcaagaccgccaggcccgccagcatcagcactgctgcactcaccacggcgatcacgtgagatgctttcaacgctgcccacctctcgctggtttgagggggcgacgcctgctggtacgcacaggcttggttgatccagtccgccgttgattggcaggcctgggtttgatcggcttgctgggacccggtttgggctccggagtcttaggctccggcttcacatgcctaggcacttcggctgcggtgggaggagtcagcacgtggcgtaccggcttggtgaccttctgggcacccgaaacaaccggcttagacaccaccttggcacctttgaccaccggtgcggctgccttcgcgccggccttcttgactgcacgatgcgctttgatagccccggcctcggcccggccaaccctactagcagtagcatcgagggctctgtgacccgtcgttgccctcaccggtgcatccttgccctgacgggcctgcttcgcgatcatcgacataccgccccgcaacgccgaaacacggttgtgagcgtgggcgacggccgacataccagctgtcgtaattttcgactggccctgcggagctcctcccccggtacggatctgacgatatgacgccgaagcacgccgcgccgccgaggccattcgcgccatcttcgcagcccgggtcactcccaccgacgcgccaccggtgactaccgcagccgcagccgaaaccatccgccttcgacccaatccagtgagcttgcgaccaccgctgcgcaccatccggcgagcaccccgcccagcccactggccaatcgccgacgccccttcagagcgcttactacgcatccagtcgttgatcttggccctcagcccctcctcacccttgtgactacgccacagagacaccaagaatccgatgattcccacgatttccaacatgttgacgaccatgaccttgatgacaacgttgccatcagaggcgaagaccgacttgatgacgagcatgaccacgcccagcatcaccatcgacccaacaatgccgatcatcgagtacaagatcgaacacagatcccggataagcgggtctgtgcgaccaggaatagcccgcagcacgttgagcatcgacatgaacgccgaccacaccaacttgcacacgtagaaccagcacatgcccgcgaacaccagcaggattgctgccaaacccgtcaccgttgacgagtaaaagaagaaccccaccaaccaggaaccgtccgcaatatcgccggcgtaatccgataatccctcgtcacaatcaccgaggtcgtcgcgtgcatccgagatatcgtcgtaaggaccacctttgagcacctcgatgtacttgtcgtgacatttggaatcaataatgcggccgtagttgagttgctgatgaaccggcgccacgaacgagtccacaatgatcgcagacagcttcggagccttcgagtctcccgtcgaggtcatgtcatcaggaacctcaacctcaccagcggtcgccgtcccaggatcaaccgaactggtaatcatatgagacagcgccacaccgaactgctgggtgcgagccagcggagtagccaacgtcgtcgtatcacctgcaaaattcgccaccggggccgccaagaaacccaacgccagcgccgcagcaatcgccgcacgcgcacccgtagcccacgcccctgccgtacgtcccctcatcatcttgacgaccacgcccacaccggcgcacgtcgtcagcaacgtcaacaccgttccaccccagctgtccgctcccagcggggccaaaaccttgtcgtggatatcgttctgcaaccccaccagcggtccggtaatccacccgacccagctcatcgccacggtccagtccaacaaccggcacaacagggcaatgaccatcaggtacgtgttccaacacatgccaataatggaggcccacatactcttcagcggggccgtaacgccaccatcgtccatcgacatctggtactgaaacaagtgaataccgttggagtcagtcacattgaaaccgtcacccatccagcccagcccaggacccgacgccatggcaggcacactgctcagcgccaccaccagaaccagcgtggtgacgatgatacggaaccaccgctccccggttccgggacggcgtggatgacggctcacgctgcctcctggtcgtgctcgggcgggttggagctggcggcttcgcggtggggagcgtaggcaggtctcagtagtcgaatttcaccgacgttgccgtgctgatcggcgtacaggccacaaccgggacctccggggttgagggcaatcttgaccaggtcagcgaactcttcaggggacgttttagggtcaacgcccaggaactcgacacctttctgggcgaggttgatgttgtcgcacagcaacacgatgcgatgctgaatgaggttacggacggtctcgttggggtaatcggcctcggggtcgtgggagccagtaatgagccaggcgttggctcggcgggactcacgcacgtactcgtcgatggcgtgggaggcctccggcgaggacgacatatggtggaactcgtcaacgatgaaagcggcgtcgcgggcccggtcgctaaagcacaccaggcgagccagacgagcaatgagcgcgtagagagcccggccaaacaccttgtgcgggggcagctgacgaaacaaatgttctgacagcatctcctcggcgttaggaagagcgatgccacaagtgccaatgatgaggatgtcggcgctcaggtcggcgggaggaaggtccgggtcaaagatggccgacgctagggaggccgagttctcgatgtcagcgaacacggcaatcctgtcagcgatcgcggtggcctcgggaaggtcgcattcctcggccaggtggcgggccaaacgcccacacgaggtgatctggtggtcacgcatgtaggccggtttgaggaccttggccagcgtggtcccggccacaccgatggtctccaagttaagcaaggtcagcaagaacgactgggcgacctgcccggccatctccggaggaaggatgcgcagcgggtccagcgacagcttggggtgggccgtgtcgacgatctggcgtctaaccccgtcgatagagttgacaaaggttacccactcccgctcatcggagttgtcggtggcaataatgcgcccgccccgggccgcgatggctgcgcacagccgcttctcggccatcgtcttgcccgcgcccatcttgccgatgaacgccaccgtgttgcctttctgatcctgagtgtcggcatgcaaatcgaggtaggccagcgactgcaacggggagcctgtgaccacagccaacgggatgccggtggtacggcccaaccggtactcgaccaccgggatagatgcggcgaacgcggaggcgtgagtcagctgacggtaggcgcgaagcgaggaggagaaccggccaccgggccgggcagcccacagcaagtcctcctgacggcccacgggacgcacccacgtgaagtcaccgaacaccggatcattgacgaacgctcctgccagctcctcggtggtctcaaagtcaggagacgagacagtgacggtgataagagcctggatctcgacctcacgctcatcggcggccagctcggcgttgtagtcgacgagcacctgagcggaatgctcgatagacatgagggtcgaagcctgggtcatctcaccgccctcgacgttgtcgagctggtcgacggtttggcggatggcccgctgatttttctgcatcgcagcgtgacgggtccgggccactccccggatcgccacgtcgaccggcacgccagtgtcgtcgatacggcccaggaactcgtaggcaggccacgtcatcgtgcggggcaccttgcccagcgcaatgtgggactggtagacggtctcgccggtgtcggcaccgattttgaggacgcgacgattccacgcctgagccgtccgggacatgtgggagactcgcttgtcatcctcgctggccagcaggtcggaggtcgcggcctcatcgatgaccaactcccccagcgcggcacgtccaacctcatccatgagggcgattccctcgccaggggcatcatcacgcaaccgggtcgggtggcctgacaggtgctgccgaagccagatctgttcatcaacggtgaccgggcggggttggaacgctgccggcagtttcgcaccgaattccttagcctgacggagggcccactcccgtgcgacacggccaggagcggtggtcatgagtccggcggcttcggtgattttgttgagggcggcggtccaggcggtgtgggtgcgtattttctggtcttggttgagtttgatcgataggaaccacacgcgccggcctagggattcggtttcaggctggtcgagggtggcgtcgatttcgtcggcccacacggggtgttcgctcaggtcgaggccggcggccatggcgtcgacgatttctgcggggtcggtccaggtgagggctccgttgaggcagaactcgtggcgggcgaggtggcggaataggtcgcggtgagctgcggcgacggtgagggaggcgttctcggtgacgggtcgctggaggggagtgagtcgccaagtggcccagatgtcgccggtggaggtccagacgaggttgtcgaagaggaaccgttcggggatggacatcatgactccttttcggcggcggcgaggaaggcttccaggccgctgcggcgtacagcgttcccggtagggtgcaggggttttctgggggtgggttcaggtttcgggtctgggaggggtttgggctcgtaggtggtgtcgatgtcttcggcgaggacgtggtcgagcaggcaggtggccggggtgtcggtagtctcgtccagctcgtcgatcatctcgtcgaggaggttgggggtggtggatgcggcccacacaggtgggatagccggtgcgggtcgaggcggtgtggggaggcggagtttggtttggccccagaggggtgtgtgggtcatgccggcgggagtggtggcggcgtgagtggtcacgcgccaccagcccgccagccatgccagaggtgaccaggtccagtcgatgcggccgatgatgaactgggcgagccatccggcggccagcgcgaagatgaaaccgcggatggtcatgcccccgtcgataattttgaagcccatcatcgcggcaggaactacgccgccgacagcgagcacctgatagatcgtgtaaggcccgccggggatctttcgacccgaagagtccttgccgatgatgcggggctgctggcgggcttcggtgtgccactggatgtccatgacttgcttccgggttctcggctctaccgggcgggagcctcaatagcggcctttgtgtgctggggaatgtccatgtcagcccttgcccagtccctgcatcatctgtccgaagaattggatggcgttgccttggatgagccagtacgccatgccacagacgaacagcatggagacgattttcgcgaggctcatgccgtgtcggaagatgttgaacgcggcgagggccatgactgcgagcatggcgacggctcgcactgcggagtttccttcacctgccttagttgtggtccattcgaagaggttctgcgattccagtggcagcaggaggaattgatcgagcatgagaggttttcctttcaggaagccgaccgggatggtcccggtactgacgggctgggcgacacgggtgtgccgtccggaggcagaaggcgtgacggctggtcgagggaggcaacctcccagcggcctgcacgactgacaagagtcaggccgtactggctagtccgggtagtggattcgtcaccggttagctggcatgtcacggtcgcggtgacagcgatcttctgccgatctgagggggtggggatctcgtcaggccccaccacatgagtggttttcaccgatacacacggggctgggtcaatcgccgtgaaagcggtccccgggctactccatctcgacaggtcgtcgctgccactcagcatcgcggccaagaaacccgaagaggtctgggcagccgggtcagcaggacgaatctccgaggagtccacgtcgggggctgaggccggtgcaggcatggggatctgcccaggcaagcgaagagcgatagctttgccgccggcatcgacgtggaccggaaccgaccaggcctgtccgctcccggattggccgcccatggtgatcactgtgacctgccacaggctcggatcagacggggagacggtagcgtcataggcggtgacggtggtgggcgctggaccaggtttgcggggcaaccgagcatcggtgatcttggacgccactaagtggcccagattgtctaggctctcagagtcagatgtcagcagcagagtcgtcacttcgactgcggtagctgaagctatctgagctgtgcggcgatcgtgatgggtggtatcagcgctgacagctgtagcgggggcatgcgaagggaccgccgaacggatcagagcgacaggaccacacgcgaccccgcacagcactaaagcgaggaagcccttagtggacactgatccggcgtggggccaggggctagcttcttcttgtgtctgcttcttcttggccaaccagcgacggcgaggcctggggttagcggattcgccttctgagttgtgtgctcgtcccagtcgcataggtcacctccttcattcactgcatgaagggatggggcgggtggccgatgtgcggtcaagtgcgaaaaaagttcaaattttttcgcgggctgtcacaaccacgattacagcggggttggtagcaggtttcacgacaccgcaggtatgtgagcctcacaaggggaacccctgagatacagaaacccagcaagttaagcgagtcgggcccaggcgggacggtcgagtgttgacgagaggtaggcgactcaggctggtggcttgccacgccgccagctccgtctggatgctgccacgaatgcgcgcctcgatgtcatggcggctgagactggacgcagtgcttccgacattatgcgcaccgccctcgtcaattatctcgacgttgccagctgagttcgggcatcccagacagtgggggcagaccaacggatcgcccccacgtacgcgtggcgagccgttatcgtcgccacactcggacggtgtcggtggtctttaggggtgccccttcgggtcccttgaggtagctgttgatccatcggggccggtgggagtgatcactggggtggtattgctggcgccagtggccgcgcacgaggaatcgcgtgtgaaggcggcgtcctgtcccgtcgcggtcggtggcgggttgggtgcgcagaggtcgcagatcgacgattgtcactggtgaggtcgactcaccggtacgggtggcccgctgcacgtcgcggcgcgactggtcgcggcggcggcgttcggcgacttgcggctgggccatgagggtccaggtggcccccacgagcgccatgaccgcgccgacctcggggcacgcgggggcgtaagcaccggaagtaccgtctccgtcgaggggcacactcacgacgtttccgacacgcaccgacgtggcctggtcgtcgaggacgaggatgacttggagctgggcgccgatgacgccccacaagacaccgcgcagtggctggcgaactgtcaagggtgctgccgcactcgcctggtaggccgtcaggcaagtgactggcggcagtggtccggcccacatgagtaggccggtcgggcacggtagggctgccgcgacggtccaggcgggcatatcagtcgacgcgtcaagggccagcgcggtcatgtcacggctgacccagtacaagtcagcttggcggactcgcgtagaccattgcggcgtaccgggcggggctggatgacctcgccgtgtcatgtcagcatcgagggcctccacctcggcggccatggccgccctgcacgctggcatatccttgccctgttcgattcttctcgtcatggttctgtcttctgcccggggctgcttcgatacccctatcatggacacatgataaccgcaatgccaacaattacggggtttcttgacttttttgcacccgattggagaggatcggcggactggaaaatcgctgtcgaatggcgcgctttcggggccgcgaatgaatagttcaatccattgcagccgccgcaattttcgaccctgtccgtaggactcatggatccaatgtccccgcacgatgtgcggggtcatcaggtggcgacccaagggcgaaagcaatagcgattatgcggacagtttggcaccgcgtagatcagcgccggtcaggttagcgttggacagatcaacgtcgtgcaggctaacgccgcgtagatctacgcggcgttaggcaggtcagcacgccacaggctagcgtcgcgtaggttggtaccgtacagtatgacactgcatagatcgacatcgtgtaggtcaacgctggacaaattgatactgaataggctaacgccgcatagatcggctcgcgtgttatttttatgcgccgccgcgacaattgcgagcacttcttcgcgattcataattcctccatatggtctaatttttgttggcgtcatttcgcctttgtcgtcacggtagtggtgacacctgggcggaacctccatgtcgacatgttcatagtagatatgctgtggcgtctattttatggtggattccttatttctgggcgaggtagttgtagatggtttgtcgggtggtggatagggcgcgggcggtgtcggtgatggtgtggcctgcactggtgaggtggcgggcgaggacctggtaggcggctctgcgagcggtttcgtgggtgtcggggattcctgtggtgaggggtcctagccagtcggcggcggcagtggcggcgcgtggaccccagacgtgccaccaggcgtcgacggcgggctcgacccacagtccgcggcgtaggaaggcatcggtgttgagggcttcgacgaggtgggcggcgccggcgaggtaattgcgggcagggttatggatggcgtgggcgatagctacggcgaggcgggcgaggtcgtcgtcttcgacgactgcgcgcaggattgcgagggaggcgtggacgtctccggtgcggatgtctgtgtcggtgatcgcggtgagggcgtggacatagagggggggttcggggttatcagcccaggcggcttggatcgcgccgatggcggcgcgtacgaggtgatggcgggctgcgtcgaggtcggtggactccatgaccacatcggtgaggatcgtggatagcgtgctggtcttgtcggtgaggatggctgcctctggccgatcggacgtgagtgcggtctggaaacgctgaggatcgaagaattcgaccatcgttagcatcgtggcgcggttgacccaggcggctagtggagggcctgagagtggatcagtggtggcggcatagtacgccagtcgctgctgggatgtcatggagtgtcctttcagtgtcataccgttcgggggcattgctcgcttctattatagacatatatttccccttagtgtcaacaatgacgatcccgtgtgggacgtcaggttttcagggtgctcgggtggcgggcatgtcagtgcgggacaccgctgctgcagtgaagttcttgtctgggccaccggtgaggcgcgagtcctttagcattactggcggctagttgctgcgcccatggatgggcgcactatcaggccgtggtcacatccactattgggcccgcgcgaatcaggtggtgattgctcacaggctggagtgaatgatggctcatccaggtgagacggtagctgcggtggtatgccacgcgtgcgacaacgctaggtgccagaatccgtcacatttggtggccggtaccgtgactcgcaatcggcgggagtacgtgagacgagcaggagctccaggaacaccgttaaatgacgtgcatggcccgcggggtgggcgaaattgtccaagacatcgttggcgtggaagtcgtgacggtgaacggtgccgggctagtgctcatgactgccgttcttgctaaatacgtcccgtacagaaacttttatcacgtggccggagctgtagttgtgtacgcgtgtcttgccgctgcggcggcagtgccgttttggtacatcgtcggcgtaagcggtacccaactgctcatccggcaactgatcatgtaggacgcagcgcacggcgtgccgaattaccgacgttggtcggcgcggtgtttatcggaaggctagcttcatccgcgacgcgagacatctcacgtagctcgcggcgacaatggtgacctaatcactgtggagccggtatcgctcgatgatctgcgtggaaactggacggccgaccgcgggtatctcgtcggcgatggggtggcgccgacaatcgccagtctgcagctgatctgaggtcataatcctttatctatgtcgtagcgcctgggaggcactccccagggtcgtcgtgtgtgcggaggtagggccgaaggctttggcgagataggcgacggccccccaacgctgctcgatagtgacgactcgacgactggtcgatcaactagtgtgggccggtctcccggcccacactgtgatgatcaatcggtcagactcgacgcgtcgccgcgtataggtctgtccccgaaatatcgtcgaggatccggtcaccgaagtatcgcagcgtaatttctgatgctacgtcggacagtaaccccatcgtgacttttacgacattccgacgccgtgctgacgccgacagtccccctaggctgaattgcgtcgtcccaagccactgccagtcgtcaatccacagaccgtcgccacgggtgtcggtgtggaactcggcatgggctgggacgactgtgccatcgccgagctggtagtacgagtcgacagtccacgctaggcgacccgcctcatcgcggtggatccggccgatggtgatccgatccaggtcatcagtgctaatctcggtcatgtcagaggtcctttctctgtcacgccctcggggagttgccgctcctgcgggggcttcctttgttttgatacctctattatagacacacagattcgatgatgtcaacaaatatcggggaaattcttggcttttttctgcgactttcgctgcggccggtcactgtgtcacctcgtcgatcgcggcgagggtagcttgcgtgagcgccccccagtttgctcggtacgtggtgcacgccggtcgtgccgagaagatcatatccagccccacgcggatcgtcgcacatgtcatcccagtcgtagttgctgtcgtattcgctgatatgggtccatgtcgtgacagtgaagccggtcctcatgacccgcacccacctcctgccggcaccgctccacggcacagccaccccactgactgtagtcgaggcggcatcaatccccaccaacatcgacttcgagaccatagaggcccggaaggtgcagcccggcggaggcatggcccacctgtcagcagaccgagcccgcccgatcctccaggttgcctcctggctgagcgcggcctggatactcatggccacccccaccgtggccgagcccagctcgacatgcgactcatgcgccaggttcacgccgtcactgacccgaccggccgacggctgacgaccgcgcacaatatgcctggtcgttttaggttgattacagctcccccgagctcaggtgacagggcgtttggctaaggcgttcacggcatcgctgatgatttgtttgagggtggtcccgggatgggtggctttctgatgggttagccattggtcaatgtcggcgggcagctggaaagagcgtggctgaccgggggtgcgcacggtgtgggttccgaagccgttaagggcggccgggggttgttccatatcggcggccacggctagagcatggccgatgatcgcagcgatgctatgcgaggggtggtcggcctgccatccggccaggagggattcagcgtcgtcggtgagagtgacaccgcgctggcgacggtcggttcctagatctagggcgggcagggtttctatgacggggttgtcgagccaggcacgtagcgcggcgtggacagtggcggtcatggtgccggagaccctttccagggcggtgtcgatcttgggatccaagcgcacctgaacggatccggggccctcggggagtttcccggccggtcctccgcggcgaggttggacggtgtcagccccggccacgcccagatgacggcgtagcgcagcccgcacgatggttgccttggggacgccgagttcctgggcggccgacgctagagagcgatggaggtcggcgggcaggtggaagaccctgggggtcgggtgggtgcgtttgttgctggggctctttgtcggctcggcggtgatcgggtgagcggtgacgtagtcgtcaatgaggcatacggccaggcggtaggggcgaattccggtggtctcggccatctcatcgagggcgtcacgcatatccggggtgacggtgagcatgactgagactcctccagtgcgggatgctctggcagctcggccacgggttgaggaggggatggtgtcggggatgcccagggcctgcgatagcgcggtgcggcacacggcggcgcgggagactccgcgataggtgacgagggcgtcgagggccagggcgagggtgtcggggatgcgcaatgccagtcccgggttggtggcgtgggggcctttgggtgccatcggttcggtattggcggggtgggcagccaggtagtcggcgaggatgtgagcggccacttcagagcgactggtgtgggcggtggcagcgcggtcagccagagcggcacgtatctcgggagtgatagatagccctagctggaacgtggccccggtgtgcggggccggcgtggctccacgtcggtaacccgcgctgatcgtgtcgggtagatggaaggtttcagccagggcggttcgagcaaccgccgccagggccacattgcgcctatctgctagcgcgtcgagggtggggcctagctcgggcagatggaggggttgcggacggtcatgatggggtttcctttggtacgattgaaactgagcgcgatgcttatcgtgttcgatctgatgtgtgggtcctcgccgagtagcgagggcccacactgtgttgttgtcggtttataggtcaaggtggggtattccacacaatccgagagtcgtggttggcggcagcgttgtcgaccacgtcgaggatgtctgcagcagacgtcgtgatggtcagctgccggtctctgatggttttgtgagcagtggcttaggtggagttgccagcgtcgactagacacacgtcgatgtcaggagatagtgacgtggccaccacgttcagcttatgttaagcctagacattaacaccacggtggacaagtcctgccgtttccccttggggggctcatgctgatctggttgtccgctgtcttctcactagatgtgtgctggtttttctgctcaccggtacacactgctcattgctagacgtcgtgtctatgacatggctgggcgtctagcagacgagttgacatcacccttaggctggcagcgttcgaggccgcaggccagagaaagcggacagcctaacgattgacgtccccctctattcttctctcccgcctcccctccccccgtcccctgaaagccgctcttcatctagcgttcccccgccgccgacaccttcctcttttactcaggttgagtcgaccatccatagatagatacatatgcatcggtgtatcgatctatcgatgtatctgggtctggttttaggaggagacgctcccagctacccctagagccaggcccctgctttaagcgtgctgccaggtaatgcccccggtttggcgagcggtcacccacacaagggctgggctggttgctactcccgccagggatagcggacatcctctatacacgtctgtcagtccatctttttcgtcgtatttccccttgtcagagcgttcttctcaaagtgacaacgctagtggccttgacgacaacgtcctcgacaacctcatggcggtggtctgtgtcttgtcagatcaaccacaccgggaaagagacaccgccgatgttcaccaccacagccaccctcaacgatgaatgggaccagatccgcaccattgagatcgattggcacgactgcgctgagctgatgcactgcatcgacgttgaggatgtgctggccgtcattcctgccgcccccgacgccatcttgggctacctcattgcccgggctcagggcggtgatgagttggctactcgcaccgtcatccaagcgtttgtcggcaagctcattctaatggccactgccacgaagctgcgtcgcactaataacggtttcgatgatctgttggcgggtctgtgggagacgatcatcacctatccgttggatcgacgtcctgacaagatcgccgcgaacctcgtcctcgatacgttgcaccgagttgtgaagttctggcgtgccgattcccccgatgaggaagacgctcacggattggtgcccttccccgatactcttatcgcccccgagcccgatgaggacgtcaccgcatcccaggctattgccctggctgctgaccgtcattggatcaccgaggacctggcccgcctcatgaggcacatctactgcgacggcatgaccggagttgatgcagcccgtctgcatggttgcgctccggccacggtgcgttctcggtgtcgtgacgggcgggctgcgctacaacgcaatgccgaggagatcctggctgtctgctgatctttccctcggctcgcagccgcctccaccgatggtgcaagctagagatctagcatctcatatagttgtctagctagctagattgatagcaatttttctagctacatctctagcacatggtatagcggaattacggctggatcgctagctcaatggcatgcttgccgatggaaggtgtgtcgacctcccaaaaagctggaaggagctttaccgtgcagggcatgaccagtcccattgaccgatccccgttcgaccgcaccatcgcggtatggaaccacaagggcggcactttcaagacgtccgtcgtggcgaacctgggatacctgttcgccgccggcggtaacaaggtgctgatggtcgacatggacccccaagccaacctcgacatcgacctcggtatccctgctggggaacgcgaacgaggcgtaggactagccgaggcgctgcgtgaggggaatacccttcccccaccgcagcatctcagcgagaaccttcacctgatcagtggtggcccagccctcaacgaattcaccgaccccgcctccctcgcagccatccttgagcgggtcacaaccgcacgttacgaccttctggcccaggcgctcgcaccactagcctgggactacgacctgatcttcatcgactccgggcctgctcagactctgctatcccagaccatccttggagtagcccgctacctagtcgtgcccacccgcaccgataacgcctcgatcatcggccttgttgacgtccaggacgccatcgacggggtcgccacctgcaaccccgatctgcaactactcggcgtcgtactagccggggtaggcgcccgcgccactcggatcgccgccgataaacgccacgccattgacacggtcctgggaacaggaaccgtcttcaatgcggtcatccactactccgaaaaagtggccgtactcgcacgccaacaaggcaaaaccgtcgccgagctagccgccgaataccaccacacccagcccgcctacacctacctagcccagggcaaaaaggtccccaacgtcgccaaagcggccgtcagcatcgaaaccgactacctgcggctggccaccgagatcagtgaccgcatgtgcaccgacgacgagcaggaacccactcatgactgacgacccgacctcacccacccaaacctccaccagcgacgacatgcgcctagccgaggaatgggccaatagcggccgcacggtgggggcccttccgcaccgtcaacggcctaaaggctctattccccgcaccgccgaacagccccctgtctcgtcccctgccacccacacaccagccccgaagaaaccccagacggccacaaccacccagcccggacgccagcggatcaacgtcaccgtctacgtcgtccccgcactccacgagcaactgcgctcccggtcggcggcgacgggggtgacggtttcggatctggtggtgcaggctttagcgttcgtcgccgatcacgcagccaaggctgtcgccgatgacctgcgtgtcgagacggtccctggtgatgaggctggattgttcgatgtgaccccgtcgcggccggtgggggtcgccaaaacccagttgggggtgcggatgacccgccataacaaggctggtttggaccagctgacccagatcagcggggcccgtgaccgcagccatctcgtgtccgtcgccgtgcgcgactatctcgactccaaccctgtaaagaaaggccgacatgtccgctgagactcctgctgcttccaccgagcggcgttttgatacgaccgtcaagcccaggcggcgacccttattcgtcgcggccggtatcgccattgtggtggtcggcgcgttgctcatcacccagttaatccacgcgagccagaccgagaatcgcgtgctggaggttcatgccgatgtggctcgtggcgaggtgatacgtgacaccgatctggtggcggtaaccgtcggccaggtcgacaacgtgtcgacagttcccgctgatcagctcgactcactggtcggcaaacgcgccacggcagatcttcgagccggatcactcttgcctgccggggccattggtccagccgatgtcgttccagctccgggcaagtcgctggtcgggctgaagctagccgccggacagatccctatcggagaccttgctgccgggacgaagctgcgcctgatccagacctcggcaggcgggtcatccaccaccgggcagggcgccaccaataccgatattcaatcgtgggctgcgacgatggcgtccggcaccaaaagtactgagcaggtcaccttgatcaatgtggaggtggactcgcgtgatgcagctcggatcgcccagctgacatcgcagggccgtatcgctgtggtaaaggattcgactcgatgagcacaatcgttttgaccagtgtgtcgggagccccgggggtgaccacgacagcgattgggttggggcgggtctggccacagtccagtctggttgtcgaggacgacacccatcacgcgatgttggcgggctatctgcgagctgcccagcacgccgagccgaacttggccacggtggcaaatctgacggccactccgaccaatgcccaaaccgtgtgggaatccatcgccaggcctctgcccaccgatgatccggtcagcgggctgagacgcaaggccgtcctcggcccgcccacaccgtggtctcgtgcaggtatcgacccccggtggggattcatgctggccctgtggcggcagctggccgaggccgggatcgacaccatcatcgacctgggtcgcctagccacgccgctgacgtcaacgccacatctgatcgccacacccatcatcgacgacgccgacatgatcctggtgatgatcgaggcgacgctacgcgatgtggccggcgcccacacgatgatcgaagggctggccgagcagatgaacctggccggggcccaccagcgcctcggactgttggtccaccgcggcggcgcggcccgcggggtcgctgagttcaccgacaaagagatcacgtcggcgttgcagctaccggtctgcgggtcgatagtccatgacccagtcgcggcagcccagctgtctgacggggtcgggcagcggttcgacaagtcgcgtctagcacggtcgttgtcgaaggtggcgggcgttctcgttgatgtcattggtaggcgtcgtgctgatagcaaggaggatctgtgatgaccggtttttcggacaatccgttcgacaagttgcgctcgcgtcctgatgctgaggtgtggtcggcgtcaggggccgtgcaggtaggcatgggggaggctccggcgggggaggggcccgggtttgtttcggagttattttcggcgtcggcggggtgggccagttctcagcaggtgactcaggctcccccggtgatgacccgctcggagaaggttgattggccgattgttgcggagctggccagtacggccacagacgagattgaggccgagatcacccggtggagttccacccatgatggggtagcgacgctggacattcgtcaagccatcgcagagcctgctatcgcctcggctgtggccacgtatgctgaccggcgtcagatcgatgtgggagagacctggcctgatctggtacgtcagcgctaccgcaaggctgtgtgggatcagctgttcggaatggggcggctacagccgctgttcgaaatcggcgacgccgagaacatcattgtggtgggcaaccatgaggtggttgtcgatcacaacgatggttcccggtcgacgttaccgccggtggcggactcggacagcgagttggaatcccaaattgcccgaatggcgaggaatgcgaccccgcggcgggccttcgacgccgatcacaccgatgtgacgatcatgcatgagcagaagttccgtattcacgcgatctcttcggaggtgtcgttgcagccatcggtggtgatccgccagcacttgctgacccagatcagtttgggggacctatcacagcgcgggatgatgccagtggaggtggcccggttcctggatcaggcggtgcaagctggcaagtccattgtggtcgccggtgagcagggtgcgggcaaaacgacgtttctgcgcgcgttgatccacgccattccgatgcgcgagcggttcgccaccttggagaccgatcaggagctgttcgctcacttgatgccgggccgacaagacacgctggtgttgttcgcccgtgacggtaacggcgaggtggatccggcgactggcacccagcacggtgctatcgagatcgcccagctcattccccctagtctgcgccaggcgttgacccgggtcatcgttggtgaggtgcgcggaaatgaggcctcggcgatgtttcaggctatgcagtcggggactggcactatgagcagtatccactccccgcgagcctctgaggtgccgtcccggctagcccagatgatttcgatgggtccggtctatgacctggatcaggccatgctccaaattggtcattccatcgactacatcgtcttcgtgcgcaagcgtgacctgtctgacgggacccggctgcggttcgtcgagcagatccgttcggtttcacctggcgattcgacgactcccagtcttggcgaggtgtatacggccgattcgtggacaggtcagccgttaaccccgcttatgcctggttcagcggccgatgagttgtctcatttcgcccgcgacttggattattgcgaggcccactcatgaacgcacctgcactgaccagcgccctcatcgtgaccgggttggggctgatcttggttatcgacggtctagtgccctcaacgcctcgtcctggagccgcgctaagcccggcccagaggtgggccaggctcacccaccgtcccgctggtgcggccgggcgtcgccgggatttgcgttgggggttggctgttcttgtcggtgtcgtgttgtttgtgctcaccgggtgggtggctgcgctggcgttgggccccattattgcgctgctggcccccaccttgctgggggcggccccaccgaccgatattccgctcatggaggcgctggatcggtgggtgaggcaggtggctgcggtgctaccccaggggcgcgacatcatcacagcggtgcggatctcgaggccgcgggctccgaaaatgattgccgagtcggtggaccagttggtgtctcggctggacggacggatggagccgcgcgaggcatttcagaggatggccgacaagctggactcggctgaggctgacgcggtgctggcctctctggcgttggcggccactcatccgcggggtgcctcgacgacattgaaggctattgctggcaacattcagcagcggttaaaagtgctgcggcaggtggaggctgagcggtctaagccgcgcaattcggtgcgtcagatcacgctggttacgatcgccatgttcggggcgctgctggttattgggcgggcgttcctggccccattggcaacccctcctggtcagatcctggtagccgtggcggtggtcatgtatgtcaccgcattagtgcagatgtatcggatggcgcgcccgcggcaccgcacgcggatcatggttaggaggagtcgatgacgacgactgcgttgtccctgctggccggggctattgtcaccgtcgggttgttggtcatcgtggcagcgttccggcctgccccaggccctgatctagtagccgccttggacgtggtatcgggtcgcacctcggcccttgacgagcaggtctaccagacccgggtcgggcgtttaggtcgcagcgtgacccgcacgttccatgtgtcggtgtcgccggcgatgcgagccgcgctgcggttgcagggcgctacccccgaggcgttctacgggcgtcgtttgatttgggcgttatgtggggcgatcctgccatggctactcaacgcggtggctatcgcggtgggggtgaatttcccgggcttgctcatccctgcggcgctgtgtgtggcgctggctggagctgggtggatgctgccggcggcacggttgagggctgcggccggacccaccaacgatgactcgttcgaggcgctgctggtgtttatcgacttggtcgtgttggaaaggctcgccaacgagacctccgtcgacgcgctcaccaacgcggcgaacatgtcagatgccccactgttcgtccagatccgtcaggtcctcaaccgtgccgccctggaaaacgtcgacccgtggaacggactcgaccggctcgctgacgacattaagctgcccgaactcaccgatgtggtctccatcgcccgcctccaggaggaaggcgcttccttagtcgatagtttccgggcccgggtcgccgagttgcgcgacgcctacttgctgcgcttgcagcaagagtccaccacgatcacccagcgccttggcctgtggacgatcctgcaagccggatcggtcatgctcatcttgatgggggcggccgcgctcacactgattacagccggataaaccgacatcgtgtcgagcccccatatgggccgcgaacctttcataatgatgcctgtaagcaccacaatattgatcacaacctaacaatgaaggagaaatcatgatgaccgatctcgacctggctaaaaaacagatcacctggctggcggcgcacctgcgttcccggatcgttgacgagcgtggcggtggtagctctaccgtggagacactgatttggattggtcttgtcgtggcaacggtggttgctgtgggcgccgtggtgatggcattcatcaagtcgaagatgcctcactgacgacgatgcgtagcaggttcacaactgatcagcgtggcggtggtagcgcgtcggtggggatgctcctgctgatgcctgcgatcatgctgctggcattcggtgggatcgaggtcgggatgtggtgtcacgcccatcagtcgaccatcgcggcagcccaaagcgccgcggaggctcagcgtgtcgtccatccagctccggggtcggcacaggaggcagcctcgcagatcactagtcatggcggggtgcgtgatgcgcgggtgtcggtgcgtgatgatggttccactgtcacggtgaccgtctcaggtcgggccccatcgatgctggggctgcatcttccggctgtgtcgtcgacagcgtcgatgcccaaggagcgcctgtcgtgaggcgaagtgagcgcggtggagcaagtctaagcgtcgaggtgctcatgtgggcgccgatcgcgctggtgatcatcgggtttgttgtgggtatcggccggatgtcgatggcccaggacgcggtgagtggcgcggcgggggctgcggcccgtgcggcgtcgttggagcgtgatggacagtcggctcagtctgcggcacagcaggcggcgtcggcaaacctgtcgtccggtgggctggcatgtgcgccgagtgtgagcgtggacacgtcagtgtttgcccgtcctgccgggcaggcgggcacggttcacgccacggtcacatgtgtcacctcgctgggtcttgggttcgggtcccggacggtgcacgcaacggggtctgccccggtagacacctatcgggaaaggagaggctgagatggcccgcgatgagcgtggtggcggctcggtgtcggtgtggatgctgctcatggtgccagtgattctggtcatggccggcctggtttttgacgggtcccgtcagatatcggcaacccaggcggcccaggacgcggcggttgcggcatcccgcgccggaactgatgcggcagcgacaccgcagctagctggccacgacggggcggccgtagcagtccaagcggcccgccaggcactatctgctgccggggtggacgggtcggtgcaggaggacgggtcgaccatcacggtgaccacgtctcaaagtcggccgacagtgttcctgtcagcgatcggaatcagccaggtaagggggcatgggcaggcccatgctcagcttgtgggaccgggagaacgcccatgacagtgatacgtcgtatcggtgccctggtggcactgcttgtggtgatagccggcttaccggccgggctcgtggccgcaggcgccccgctagtaccctcgggcctgtcatgggcccatgtgcggcatctgttggttaccccagacatgaccgggtctgtgctggtgtggctggtcagcctcatcggctggatcgggtgggcatggttcgccctggccgtcgcagccgaagcggtgacgatgctctcagggcagcggctgcactggcacatgcccggccctcgcctagtgcgccgagtggcagccggtcttctcattgccgcgttcgcggccgcaccggcagccacaagcacggctcacgccgccgaggccacccatgtggcggtcgccgcccaggctggaccggcacacgcggcccccgcccaggacagccccgccaccacctctcaggccccggacgcctccaccactccgaaaatctggaagacctacacggtgcgggccaacgactacctgtggaagatcgccgagcactactacggtgacggcgcccaattccgtcgtatcgccgaagcctccggtatcgacccgcactcagagctgaaagtcggccagaaactggtgctaccggttcccgagaacacggccgcagttcattcggttaaagcgggggagtatctgtgggagatcgccgagcactactacggtgacggtgcccagtaccataaaatcgctgaagcttccggtatcgatgcccattccgatctagccgtgggccaaaaactcgtcatccccgggcccctccgccacgacgccacgccgccacaccactcggcgtcgacccacgcgaaggccgccaccccagcccacacgcccacgcgacggcctgcgcctgcccacaaagccacgcccgccccgacgccggccaccccaactactccgacccacacggtgaccccagctccggcctctgccggccactcgaccagcgacgagcacccaatccatacggataccgccgcagcggacaaggccagcgacgaggacgccctgtccccaatccaggtgggtttgaccgccagcgtcggactggtgctggtcgccggactgatcaccaccctcaaccgccgctaccggacccggttcacccgccagccccgcggcaaggccatgaccctgcccagcccggacgcccaaactgccgagatagcgctgcgcagcaccggggcgactgacactctgacgatcacctgcctcgaccaggcgctccgcgcgatcggcgcatggtgccaccactgcgggcacccgctgccacccctgctggccgcccgcgtcgacgacgaccggatcgacctgctgttatcgcaggtgacccccgaccatcccgaggcggtggagctggccgccgacggatcggtgtggaccctcaccgccgaccggatcgacgacctgctagcccacaccgatgacaaccaagcggctccgtggccgtctctggtcacactgggacgcgacgacgacggcgcccacatcctcatcgacttggaagccgccggaaccttgcacctgatcgccgacgacgaccaggtcgacgcggccctcgccgcgatcgccgtggaactggccacctgtgactggtccgacgaagtcaacgtcaccctcgtcggccaggtgtgcccgggcctagaagaggccttgggctctccaaccttgactcgcgccgccaccgtcgacgctctcttggagacgttggaggctcgcgccgacgatcagcgtcacgttctcgccgaaggaggctccctggccactcgccgagccgacccggctatctccgacgggtttgacgctgaggtgatccttcttgacaccgacctgaccgagtcccagcgttaccggctcaccgacctgatcaaggacctgccccgggtgtcggtggccgcggtgacgaccagctccaccaatccggatgactgggccctgagcttctcaggtgacccgctggtcgcagagttggtccccctcggctggcacatcaccccccagaccctctccccagatctctacggccgcgtggtcgaactgctagacaactctgcggccgacgactacgcacccgccgactggtgggaccatgacgccgaagaaactgacgaggatgagcctgtcactaccagtaggcgagcccgccctagtatccgcttgaccaccctgaccggtggtatcgatttatccagcgtcgacattgacgccatcattgatgacgccaacgaggctctcgatgctgaagagactaacggcggggtttgtgttgatgctgcccagcctggcactaataccccgttccctatcgatgaggttgacccgttaagtggtgacggtccggtcctgtcgatcattggtcatcccgacatcatcggtgccgctgggacgaagggccgctctccatggcgctgccagcagttggccctttacatcgctgagcatccgggagcatcaggagccactatcgccgacgacctaggtctctcacccgcaactattcgttctatgaccacgcacctgcgccgctggttgggtgctgacgggaacggggtggcctacatgccccccgccacgcacggctaccggcttgatgagcgggtcgtcactgatgtggatttgattgatgctgctttggctgggcgaggcatcaataccgccgacaccaccactcttgtcgctatcctcaaactcagccgaggccgaatattcgccggaattcccgactcagacctccgacagttccgagcatccacgtaccacattgaagcccggatcgttgatgcggctcttcaggtgacggatcgggctttggaggccggggacttggatctagcccggtgggcactcacccaagggctactagcatctcccgatcatgaggacctggtagctggatgtgtgcgcaccgagtaccaggccgggaacatggacaaggtcgctgagctggttgatcatctatcggctaccgcgcgacgcctgggtgtcgatttgaacgaggacactacccggattatcgatacagtcactcacttgggcaggaaagcctcatgaatgctcctgcgcctcatttgttttgctagaaaggttttcatgcatcatcatcgcatcatcgtggctgcggtagcagtcgctgctcttacggtcggctgccactcgacaggctcaacatcggcccctacaccggcaccaagtgcctccacggtctcggcgagtcctgcccctagcccgacccccacggcgggggcgatcagcgcgaccgacgccgaaaacatctaccgcaccttgcacaccaacgtcttcgagttggagaagaagggtggcctggtacccggggaacccgcacccgcgaccctgtcgaactacgccaccggccaggccctcaagaactacatgaccttcatgcaccaaatctcgggtctaggtctcacatggaagtcgggagcctcaaagatcactgtggtgcgggagaaaaagggtgataccacctaccccgaggccgctatcgccttggaatcgtgcgaagacggcagctccatccgatcggtggaccgccacggacaggctgaccatggccggctcacacacgtcgacagttggtatgcccgcgataagaagggcaccatcaaaatgatcgcacgtaacggagtggaggtttcctcatgcgacgtcaagtaatcaccgcggccgtgctgggcctgaccctggccaccacctccctgcccgccctcgcagataatggagacttcagtggccatacagacacggatggtcctggttacgatgtgcgtactgaggtggattaccatcacaccaccggtggtgcgggtgggggtgccacgacagggggccatcatgggggcaaaacccacggtgatggtgaaggtgaggctattgatgggcgttctcgcgccgatgccgaagccgaactagacgaagccgaccgtaaccaggacttgacttgtgatgtcatgctcccaccggcgccgaataccccagccggccaggaatgggcgaaagaatgcaatcccccagcgaaaaaggggcagaaggccaccccgaagcccgacccggtgttagtgggccgtcacgcagccttgcagctcacccttcccggcgcggcccctcgtatcgatccgtcccccgaccttaaccggtggcactcggcagcagtgggccaggctttgtggttgtcagttgatgaccccaccgccactacacagaaatcgatcacgtttatgggccaggttgtctcgttgagcgccaaacgtaacggtttgtcgtttgatatgggtgatggtcatgtcgtgcactgtgatgccacgacgacatggacggagtcggtggaaccggggaccccctcacccacgtgcggttacacctaccaacaggcagccccggccgggggctataaggtcaccgcgatcacttcgtgggatgtgacctggtcggtactaggacacacgggcacagtgcatgttgagaaagccggtgggcagatgcttcccgtcggcgaggtggagtcggttgtcacccgccaatgacccctgataacccgagtctctacgaggtgttggggataccaccacaggcatccccaacacagatcaaagaggcatggcgcaccaccgcgaaagcgacccaccctgatgccggtggcaccaacgaggccttcacaaccgcccagcacgcctgggaagtgctgtctgatcccgaacagcgtgctgcctacgatgccgccctatcgggggaggacgcctctgaccaggaggcccttgacggcactgtggacgtcgaccccctcgccgagtggccttggtgtgtccccttcctcgaggccaccccacgactgcgccacccgtgccccggcatagttgagtctgtcgtcgtggccgccgccgggatcatgaccggcatcggctggcacgagctattgaaatcacttgtcgtggccccggggttcgtgggggcgtggtgggtgatttcggttccattggtcgtggcagtgacatggctcggcgcgatcacggggatttgcgccatcatggccgggctcgtctggctgggatggggtctgatcggtggtgcggccttgtggggtcagccgtgggtggtcactgcgatagcaaccgggtgggtggcctgggtggccggtgtggtgtggtggtggcaccgacggatggcctggcctgcccgcacctgccgggcaggaaacatgattgacatgcccgaggatgacccgccgtgggtagaaccggtggagttggtggcagaactcatcccctccgtgcgggctatgtggtcccctgataggcaaaccgttgtcgtgatagccggtcggcgggtagcgacgttagggatgccgatgcgagggtggcgtggcatcgatatgcggggctggaacccgatcggtgccgacaccgcgtggatcgttgaccagataggcggctggctggccgaccaagacaaaccgctcaccatcgacgggcgcatcttgtacgagacctgggacaggctacagacagttcgtcctcacagctgagaaaaattttgggtccgccctgcatatcggggcctcttcataccttcaaaagtgtgaagggaatacagactcttcgactggaattaaaatggtatatggcgtgtccggtccgcacccagctccacgatgcgccatagaggagccataacttcaccaatcgtatacgatatgagtgtaggtgagcatctaccggtggccgacagtcagatacaagcatgggcggatgaagcagaagctgattatgacctcagcatgcttccgccgtctcgacgtggtcgcccaccggtggggaggggcccgggcactgtggtccctgtgcgcttcgacgcggacactctcaaggcgttgtcacaacgagcccctgacgaaggattgaccacgcgttctgacgcgatccgtgctgcggttaaccagtggctcggcctcggctcgtaaacattatcggcgcgacaaccttactgatgacgctgttggttacgccgtagagcacatcttgtactcgtgggcgctcgacgatgccgatgatcctcgttgctggatgatgattcggtgttgacccagctggcctcctcatggagctagttatcctcatctacgacgatggctatgaactcctgatccacgccatgaaagcccgccctcagtatctgagctacttcgctatctagtgttgttgggcgagttgaactcaacttttctccgacgcaagcgccaataaaaggctgatccatccgaataccaccaaacacggctgaagtgtggaacagattcagcaagacagggtgcggtgctcgggtgcgttggggagatgaggatattcaggcttctggcgggatgtggcttgatgacgtccaggatcaccggttcggttttgaaggtgccttgcattaatgtcgacagggtcgtacgactcgaggactggatcgaccagcccgttgcgtctgaagaacttcatccaccccggtggagctccggccgcgtactggtgcaacggatcattagcatgggtagcgtgagtatgccttcgatcgtggtcagtgctgtcatcatccaagattctgacgggcggcttctcactgtccgtaaacgaggcgccgaggcattcatgctgccaggcggcaagccggagcccggcgaggactcgcgtcaggcagtagtccgggaagtgcacgaagagctcggcgtctcattgtcttccgacgacctgcgtcgggtgggagtgttcaccacgcgagcagcgaatgaggccggccatcaggtggtggcgacgattttcacccacaccccggttgcggtgagtgagccagctgctgagatcgagcagattcgttggctcgattggagtgtcgacgccctgcctgatgacctggccccgctgctggtcgaggcagtcatcccgtggctgcggcgccgtatccggtcggtcgctgtattcacgggtgcgaaggatggaaccgaccctcattatcgtgtcgaagcaaccgccttgggccggggtctcgcacacgccgggatcaccctggtttatggcggcgggaaggtcgggatgatgggtgctgttgctgatgcggccctcgctgctggcggcgctgtgatcggagtgatgccgcagcacttggtggacggggagatcgcccatcctagtctgactcacctcgaggtagtgcggactatgcatgagcgcaagcagcggatgagtgacctagctgacgcgttcgtcgcgctacccggcggcggcggaacccttgacgagctattcgaagcatggacatggcagcagctcggtgtacacagcaaacccgtggccttgtacgactcgaccttctgggcaccgctgaccgcgctactcaaccacatgaccatcgaaggcttcatccgccctgaggaccgcgcctcgctcgtgatcgccgataccatacatcagctgatggccgatcttgagggatggaccccaccaccaccgaagtggcgctcgtgacatagaacaaatgattctgactatggctcattgacatctgcgcagcggctactagctccattgacttcaaatcgggccttggccgaggctcggttcaggtggcccggaatggatccccacaaattgaatgctcatgatcgaggtgatgaacgcccactctattgtcctacgcccggttgtatccagcgagcaattgaaggtgctgcgcctgttggtcgaccaggccgagccactcatcatcgacgggcgcatcttgtacgaggcatgggacaggctgcaaacagcccgtccggcccgctagaaaaaatttttagggcccgctccgcacatcccggtctgtacccacaccttcaagggtgtgaagggaataaaaacacacctaacaacaactttgtttcatgatttggcgcgtcggacccttcctgaccgatgtcgtgcgcaacaatggacccatgagttcgcctaccaagatgcgccggaagggaacacgcggcccgaaacctcgcagcgacgaggagctaacggctgtgatgtgccgcatcccagagtcagtggccgaacgtgtcagcgatatggcttgggagctgaggctctcccgatccgatcttgtgggctggtcggccctctatgcactcaactcgatgctcagacagcgcggagaggacacgattccggttccggagtatctggacaaggccgtgctcactgcgttgtatcccgatgggttgcccttcgacgaggacaacgaggagccgggcgagaatgccgggcaggaggagcttgcgatgactggatgagcccgaacatggttgaaggccgccccgccaggcgaccttcaatcaatggtttcggttgtcagctgcagccacccttgccaggtgctgtggttcttctccagaggaggagggaccgccatgaagaccaagaagacctagaagatccaaaagaaccggtttcagcttttgcttcggtcttcatggtagctgatagcccgcgtcgttggaagtgcgacgacgccgatcctcatcggtatcgcaccctgaaacagggtgttgaacatgaagggttgaccgctatgtcaagccatgagacgccctcccggagggcgtcatgaccgctttaattcaagctctgccgacagctgaactgtctgctggacctggtgctagcagtccagctagaccctctgctgagggcttcatcaagattcatcacgacctcattagtgcgggcgtgtcggggaacgcgatggcgttgttcgtcgcgttacgtaaccagcccggctgtgatcagtggacccgtcactcgtacctgcggctagcccaatggtgcggctgggatgggctgtcggaggcggcgggctgtaagcgggtgcagcgggccgctgctgagctcgctagcggtggttggctggaatcgcgggtcggccatgatcgtcgcaccgctaagacgctggtgtggcatcggttgaccagccccgacaccgaccgctgggagcaattgccgcggattgtgtgggcgaggatctgccagatcgccggggagacgtcgggagagtgggtgaggcattggctggtgtggcggatgctggccggtcgtactggtgtggctcaggcccctacgaccatcgtggcccggttcctgggctgttcttcgcgccaggtctcccatatccgtggggctctcgttgatgccggtctgctcggctgtgacgaggtgtcgggggcggcgagccgggtgtggttcccctcgatggccgaggagtgtgcagcggatcgtgaggtggtcgatggggccgtcgtcgatgctgaggtgggctctggtgaaggtgtcgaggagggcggggaacccctgtcgattttgtccacccacccctgtcgattttgtccacccacccctgtcgattttgtccgccaagtattagacaaaccattagacagtgaattagaccctgggtcgcgtcagcgtgttagctcaccaacgcgcgcgcgcgcggcggccgagccgccgaagccaacgaaccccacaccaccaacgcctgaaccagcagcccccgcttcagacagtcctgtgtcagcgcacgctgatgaggctgccgagttggcgtggcagttcgtggggtggtgtcctcagctggtaggggcaccaaagaaggtgcgtggccagctccgtcagatggttgccaagcagatccgtctccatcgtgcctggctggatgtgccggcgttgactgttgccgctgagcgagtccgggaaatcggggcgctgggtgatcggcactgcgagatcgttcgagaaacgttgcatggcgtgatcgccgaccgcaaggcagctcccccagccccctcaccctcaccagacgaaggagacacgactgtgtggatttacaaagaccctcatgagactcttgacgagtttgcggccaggactgagccctctcgtgtgtgggaggtctccgagcgcgatgacatggctggcgggatcgccgtgaacttgctggcggctaagccggatgatccgatgggctggctgactcgccggcaaaccatgctgatggtccggttcccccaagccgtcgacgaggtcgtagagatgtgtcacatcgtgcgcgccgccttggaggccgacatggccgccggaacccggtgggaggaccgatgaggtcactgcggcgaaacatcatggttgtggctggtgtgctcggcgtcgcggtagcggcgggcccgaccttagccaggtcgttgccgtttgctgccgacacgacaccgacgagcagaaccgctactgccccggctacggtcggtgcgggggccgctgctggggcgttgaaccgtctgccagtcaaaggcaaagcagcgatgaccggatacagccggactcaattcgggcaggcgtggaccgatgacaccgaccgggaactgacccgcccctggggccacaacggatgcgacacccgcaacgatgccctggcccgcgacctggtcgaggcccacctgaaacccggatcacgatgcgtggtcgcctctggtcgcctccacgacccctacaccggggccacactcgcctggcggcgcggccggcacacctcaacggcagtccaaatcgaccatgtagtcgccctcgggaacgcctgggtcaccggggcccaacacctcccagcaccgacgcggcgcgctcttgcgaacgacccactgaacctggtggccgtcgacgggcctgccaacgaagctaaacgcgacggggacgcagccacctggctaccgcctaacaaggcctaccggtgcgactacgtggcccgccagatcgcagtcaaaacgaaataccagctctgggtcacccccgcagaaaaaaccgctatggcgcgggtactagaccgctgcccagcccagacacttcccacaggagccacacgatgaccacccattggacccccgaacaactcctagaacccggaatcggagtcatcctcgacaccgaaaccaccgacctggacgggcgcatcatcgaaatatcgatcattgacgcagcaaccgggacagtcctgatgaaccaactcatcaacccccaaggagccccgatctacgccgaggcccgcaccgtccaccacatcagccccgacgatctcgcgacagcccccacgttcacccaggtgtggccccggctggaggatgtggtggccgatcgggtcgtcatggcctggaacgccccctttgatcagggacgtatcgaagccgagtatggcctcgcagggctggatgctccggcgtggccgtggtgctgcctgatgcgtttagaagcggccatgatgggctgccgatggcggcgactagacgggccacaccggggcctcggcgacgtgatagcagccaggcagaggcttatagcgttgcagcagatgccgtcgatgccagccaccgcctagaacaccagcactgacaggcgcccgagtggattggggttggatcaggcaggcagataggtgtcgagggcgtcgcggatgacctgggaggcgctggtgacggtctgggctgcgtaggcgtcgagtcgggcgttggtgcgtgcgtcgaggcggacctgacggcgaggtgaccgcccctggccggtagcgcggtctgagccgagtgccggccgtcctcggccgaggaatgcgcggctggcgcgcgcggcgtccttgccgtggaacaccgggctggtttgcggggtctgggttgcctcgtcactctcagcccactcggccagagcgtcgacatcgaacccggcaggggtggtgctcatgctcgctctccgttcagcttggtgatggtcgtggctcgcctgatcgtttcgccacggcggcaacagggagcggctgggtgtggggcggggccgggctgggccc

SEQ ID NO: 189 - DNA, 15010 bp, Propionibacterium acnes
ggccgccaagaaacccaacgccagcgccgcagcaatcgccgcacgcgcacccgtagcccacgcccctgccgtacgtcccctcatcatcttgacgaccacgcccacaccggcgcacgtcgtcagcaacgtcaacaccgttccaccccagctgtccgctcccagcggggccaaaaccttgtcgtggatgtcgttctgtaaccccaccagcgggccggtaatccacccgacccagctcatcgccacggtccagtccaacaaccggcacagcaacgcaatgaccatcaggtacgtgttccaacacatgccaataatggaggcccacatactcttcagcggggccgtaacgccaccatcgtccatcgacatctggtactgaaacaagtgaataccgttggagtcagtcacattgaaaccgtcacccatccagcccagccccgggcccgatgccatggcaggcacactgctcagcgccaccaccagaaccagcgtggtgacgatgatacggaaccgccgctccccggccccggggcggcgtggatgacggctcacgctgtctcccggtcgtgctcgggcgggttggagctggcggcttcgcggtggggagcgtaggcaggtctcagtagtcgaatttcaccgacgttgccgtgttggtcggcgtacaggccacaaccggggcctccggggttgagggcaatcttgaccaggtcagcgaactcttcaggggacgttttagggtccacgcccaggaactcgacacctttctgggcgaggttgatgttgtcgcacagcaacacgatgcgatgctgaatgaggttgcggacggtctcgttggggtaatcggcctcggggtcgtgggagccggtgataagccaggcgttggctcggcgggattcgcgcacgtactcgtcaatggcgtgggaggcttccggcgaggacgacatgtgatgaaactcgtcaacgatgaaagcggcgtcgcgggcccggtcgctgaagcacaccaggcgagccagacgggcaatgagcgcgtagagggctcggccaaacaccttgtgcgggggcagctgccgaaacaaatgttctgacagcatctcctcggcgttaggaagagcgatgccacaagtgccaatgatgaggatgtcggcgctcaggtcggcgggaggaaggtccgggtcaaagatggccgaagctagggaggccgagttctcgatgtcagcgaacacggcaatcctgtcagcgatcgcggtggcctcgggaaggtcgcactcctcggccaggtggcgggccaaacgcccacacgaggtgatctggtggtcacgcatgtaggccggtttgaggaccttggccagcgtggtcccggccacaccgatggtctccaagttaagcaaggtcagcaagaacgactgggcgacctgcccggccatctccgggggaaggatgcgcagcgggtccagcgacagcttggggtgggccgtgtcgacgatctggcgtctaaccccgtcgatagagttgacaaaggttacccactcccgctcatcggagttgtcggtggcaataatgcgcccgccccgggccgcgatggctgcgcacagccgcttctcggccatcgtcttgcccgcgcccatcttgccgatgaacgccaccgtgttgcctttctgatcctgagtgtcggcatgcaaatcgaggtaggccagcgactgcaacggggagcctgtgaccacagccaacgggatgccggtggtacggcccaaccggtactcgaccaccgggatagatgcggcgaacgcggaggcgtgagtcagctgacggtaggcgttaagcgaggaggagaaccggccaccgggccgggcagcccacagcaagtcctcctgacggcccacgggacgcacccacgtgaagtcaccgaacaccggatcattgacgaacgctcctgccagctcctcggtggtctcaaagtcaggagacgagacagtgacggtgataagagcctggatctcgacctcacgctcatcggcggccagctcggcgttgtagtcgacgagcacctgagcggaatgctcgatagacatgagggtcgaagcctgggtcatctcaccgccctcaacattgtcgagctggtcgacggtttggcggatggcccgctgatttttctgcatcgcagcgtgacgggtccgggccactccccggatcgccacgtcgaccggcacgccagtgtcgtcgatacggcccaggaactcgtaggcaggccacgtcatcgtgcggggcaccttacccagcacgatatgggactggtagacggtctcgccggtgtcggcaccgattttgaggacgcgacgattccacgcctgagccgtccgggacatgtgggagactcgcttgtcatcctcgctggccagcaggtcggaggtcgcggcctcatcgatgaccaactcccccagcgcggcacgtccaacctcatccatgagggcgattccctcgccaggggcatcatcacgcaaccgggtcgggtggcctgacaggtgctgccgaagccagatctgttcatcaacggtgaccgggcggggttggaacgctgccggcagtttcgcaccgaattccttagcctgacggagggcccactcccgtgcgacacggccaggagcggtggtcataagtccggcggcttcggtgattttgttgagggcggcggtccaggcggtgtgggtgcgtattttctggtcttggttgagtttgatcgataggaaccacacgcgccggcctagggatgcggtttcaggctggtcgagggtggcgtcgatttcgtcggcccacacggggtgttcgctcaggtcgaggccggcggccatggcgtcgacgatttctgtggggtcggtccaggtgagggctccgttgaggcagaactcgtggcgggcgaggtggcggaataggtcgcggtgagctgcggcgacggtgagggaggcgttctcggtgacgggtcgctggaggggagtaagtcgccaggtggcccagatgtcgccggtggaggtccagacgaggttgtcgaagaggaaccgttcggggatggacatcatgactccttttcggcggcggcgaggaaggcttccaggccgctgcggcgtacagcgttcccggtagggtgcaggggttttctgggggtgggttcagatttcgaatgtgggaggggtttgtggatggtatcggtgtcctcggcgagggcttggtcgagcaggcaggtggccggggtgtcggtagtctcgtccagctcgtcgatcatctcgtcgaggaggttgggggtggtggatgcggcccacacaggtgggatagccggtgcgggtcgaggcggtgtggggaggcggagtttggtttggccccagaggggtgtgtgggtcatgccggcgggagtggtggcggcgtgagtggtcacacgccaccagcccgacagccatgccagaggtgaccaggtccagtcgatgcgaccaacaacgaactgggcgaaccatccggcagccagcgcgaaaatgaaaccgcggatggtcatgcccccgtcgataattttgaagcccatcatcgcggcaggaactacgccgccgacagcgagcacctgatagatcgtgtagggcccgccaggaatccttcgacctgaggaatccttgccgataatgcggggctgctggcgggcctcggtgtgccactgaatatccacgatcagctcttgcccaatccttgcatcatctgtccgaagaattggatcgcgttaccttcgataagccagtgcgccataccacacacaaacagcatggagacgatcttggccaggctcataccgtgtttgaagatgttgaacgcggcaatgcccacgactacgaccatggcgacggctcgcaccgcggactgaccttcacctgccttgatcgtcgtccattcgaagaggttctgcgattccagtggcagcaggaggaattgatcgagcatgagaggttttcctttcaggaagccgaccgggatggtcccggtactgacgggctggacggcacgggtgtgccggccaggggcagaaggcgtgacggctggtcgagggcggcaacctcccagcggcctgcacggctgacaagagtcaggccgtactggctagtccgggtagtggattcgtcaccggtgggctggcatgtcacggtcaccgtgacggtaatcttctgccggtctgaggggggggggacctcgtcaggtcccaccacatgagtggttttcactgatacgcatggggctgggtcaaccgcggtgaaagcggtccctgggctactccatctcgacaggtcgtcgctgccactcagcatcgcggccaagaaacccgaagaggtctgggcagccgggtcagcaggacgaatctccgaggagtccacgtcgggggctgaggccggtgcaggcatggggatctgtccaggtagacgcaaggcgatggccttgccgttggaatcgacgtggaccgggactgaccaggcctgtccgctcccggattggccgcccatggtgaccacggtgacctgccacaggctcggatcagacggggagacggtagcgtcataggcggtgacggtggtgggcgctggaccaggtttgcggggcatgcgcgcatcggtgatcttggccgccaccaggtgttccagattgtccaagtgcccggagtcagaggtcagcagaagagtagtcacctcgaccgcggtggctgaggcgatctgagctgtgcggcggtcgtgatgggtggtgtcagtgctgacagctgtggtgggagcggatgccggggccgccgaacggaccagggcaacggggccgcatgcgactccgcacagcacgagggcaaggaagcctttggtggccatcgatccggtgtggggccagggacccacgttttcctgtgcctgttttttcttggccgaccaacggcgggacttagggttagcggatgcaccttctggggtgcatgctcgtctcaatcgcatcggtcacctccttcactggatgaagggaccaaggaggtgaccgatgtgcggtcgaacccgaaaaagttcaaacttttttctgggtctgcctcaagtacgacagaaggcctgcatcatcacggcgttgtggtagcagatcttgcgtcagcgcaaatgcatgggcctcgtaggagtagctcttaggtaggtcccggtggttgcggccagggcgagggtgtcgggtatgtgtagcgctagtcccgggttcgtggtgtgagggcttttgggtgctgacatgcactacccattgctagacgctgtgctgtggcatggctggacgtctagcagacgggttgacatcacctttaggctggcagcgcccgaggccgcaggccagaggaagcggacagcctaacgattgacgtccccctctcctttccccaacctcctggagtcgatgacccggagatagatcgatgtctatgcatcggtgcatcgatatacctatgtatctgtctgtggtttttagaggccactcccgtcgccccgggccgctcagcgataccgcaaggctgtgtgggatcagctgtgccgctcccccgacatggcagacagcaccgttgcatgagaactgactgacactgtggcgccgcggaggtctcccgcggcgtccgctggggcgagtgcatgcctgtcagctcatcttttatcgtcatgtttccccttgtcagagcggtctttgcaaagtgacaacgtcaggggtcttgacgacaacatcctcgacaacatcgtggcggtggtctgtgtctcgtcagttcaacgcaccggggaaagaggcaccgctgatgttcaccaccacaaacaccctcaacgatgaatgggaccagattcgcgccactgagatcgattggcatgactgccctgaactgatgcactgcatcgacgttgatgatgtgttggccgtcattcctgccgcccccgacgccatcttgggctacctcattgcccgggctcagggcggtgacgagttggccacccgcactatcatccaagcgttcacaggcaagcttattttgatggccacggccaccaaggtgcgccgtactaatgacggcttcaatgatctgttggcgggtctgtgggagacgatcatcacgtacccgttagatcgtcgccctgacaagatcgctgcgaacctcatcctcgacacgttgcaccgggttacccggttttggcgtgctgattcccccgatgaggaagaggctcacggtctggtgcccttccctgacactctcatcgccccagagcccgatgaggacgtcacagctagccaggccatcgccttggcggtggaccgcaactggattaccgaggacctagcccgcctcatgagccatatttactgtgacggtatgactggagctgatgcgggtcgtctgcatggctgcgctccagctacggtgcgatctcgatgccgtgatggtcgggccgtgttgcagcgcaacgccgagacgatcctggccgtctgctgatccctctcttgctcatgcctgccgccaccctacccctacctgctagaaacatagccatgtctccagcaacgcatctagcatatcttctagcaattgatctagctatcatatagctgatgatctagctatcatatagctgtgtctccagcccaaaggacagcccaatggcatgcttgccacaggaaggtgcgtcagcctcccgaaatactggaaggagctttagcgtgcaggacatgaccagtcctattgaccgatccccgttcgaccgcactattgcggtgtggaaccacaaaggcggcacgttcaagacgtccgtcgtggcgaacctgggatacctgttcgccgccgggggcaacaaggtgttgatggtcgacatggatccccaggccaatctcgacattgacttcggtatacccgcgggagaacgtgaacggggcatgggattagccgaggcgctacgtgaggggactgtccttcccccaccgcagcatctcagcgaaaaccttcacctggtcagtggcggcgctgctctcaacgagttcaccgaccccgcatccttagcggccatcctcgaccgagtcaccaccgcacgctacgacctgctagctcaggcccttgccccgctggcctgggactatgacctcatcttcatcgactccgggccggcccaaactctgctgtcccagaccatccttggagtagcccgctggctggtagtgcccacccgcaccgataacgcctcaatcactggcctcgtcgacgttcaagacgccatcgacggggttgcctcctgcaaccctgaccttcaactactcggcgttgtcctagccggcgtgggggcccgggccacccggatcgccgcagataaacgccacgccatcgacacagtgctgggggcaggaaccgttttcgatgcggtcatccactactccgagaaggtgtccgtgctcgcacgccagcagggcaagaccgtcgccgagctagccaacgagtaccacaacacccagcccgcctacacctacctagctaaaggccagaacatccccaacgtcgccaaggcagccgtcagcatcgaaactgattatctgaggctggccaccgagatcagcgaccgcatgttcaccagcgacgagcaggagcctgatcatgactgacgatccgactccatccgagcagaacaaccccaccagcgacgacatgcgcttggccgaagaatgggccaacagcggccgcacagtgggagccctgccgcgccgtcaacggcctcagcgacccacaccccgcaccaccagccaacctcctgtctcgtcccctgacacaccggctccgaaaaaagcccagaagacccccaccagccagcctggccgtcaacggatcaacgtcaccgtctacgttgtgcccgaactccatgagcggctgcgctcccgatcggcggcgacgggggtgacggtctcggatctggtggtgcatgcgttagcgttcgtcgccgatcatgcgggggaggcgatcgccgatgatctgcgcgtcgagacgggccccggcatgggggccggactgttcgatgtgaccccatcgcggccagtaggggtcgccaaaacccagctgggggtgcgaatgacccgccacaacaaggatggtttggaccagctgacccggacgagtggggcccgtgaccgcagccatcttgtgtctgtcgccgtgcgcgactatctcgactccaaccctgtaaagaaaggccgacatgtccgctgatgaaactcctgccgcccggggtgggcgacgctttgatacgaccgtcaagcccaggcgccgtcccatgcttatcgccgccggtatcgccatcgtgatagtcggcgcgctcctcatcactcagttgattcgctccgcccaaaccgagcatcgcgtgctggaagtccacgccgatgtggctcgcggcgaggtcatccgtgacaccgatctggtatcggtgactgtcggccaggtcgacaacgtatcaacggttcccgcagaccagctcgactcactggtcggcaaacgcgccacggcagatcttcgagccggatcactcttgcctgctggggctatcggcccggccgatgtcgttccagctccgggcaagtcgctggtcgggctgaagctagccgccggacagatccctatcggagaccttgctgccgggacgaagctgcgcctgatccagacgtcggcacccagcggctcatccaccaccactgatagcagcaccaataccgatggccagtcgtgggaggcaacaatggcgaccggcaccaaaaagaccgagcaggtcaccttgatcaacgccgaagtgaactcgcgtgatgccgcccggatcgcccaactgacgtcacagggccgtatcgccgtagtgaaggatccgatccgatgagcaccattgttttgaccagcgtctcgggagccccaggggtcaccacgacagcgatcgggctgggcagggtctggccacaatcgagcctggtcgtcgaggatgacacccaccacgccatgctggcgggctacctgcgagcctcccagcacgccgaaccgaacctggccgcagtggcgaacctgacgtcgactccaaccaacgcccaaacggtgtgggaatctatcgccagacccctacccaccgatgacccagtcggcgggctgcgacgcaaaggcatcctcggcccgcccacgccgtggtctcgcgcaggcatcgacccccgatggggattcatgctggccctgtggcggcaactggaggaggctggcatcgacaccatcatcgatttgggtcgcctagccacaccactgacctcaacgccacacctgatcgccgcacccatcgtcgaggacgccgacatgatcttggtgatgatcgaggcgacactacgcgacatcgccggcgcccgcacgatggtggagggactcgctgagcagatgaacttggccggcgcctaccgacgtctcggactgcttgtccaccgtggcggccaggcccgcggcgtcgccgagttcaatgacaaggagatcacctcggcgttacgactcccggtcatcggggccattacccatgacccggccggagccgcccaactctccgacggggtcgggcagcggttcgacaagtcacgtctggcccactcactatcaaaggtggcggccagcctcgtcgatgccataaacaagcgccacgctgatgacgaggaggatctgtgatggccagttttgctgataatccgttcgacaagctgcgctcccaggatgcggcaagagcttcggtagagcaggagcctgatgccggattagcgtcggagttgttttcgacgtcgtcggggtgggccagctctcagcaggtgtcccaagctcaaccggtgatgacccgttcggagaacgtggattggccggttgtcgcggagctagccagtacggccactgatgaggttgaggctgagatcagccggtggagttccactcatgatggggtggcgacgctagacattcgccaggccatcgcggagcctgctattgcctcggcggtgtctacgtatgctgaccgacgccagatcgatgtaggggagacctggcctgatctggtacgccagcgataccgcaaggctgtgtgggatcagctgttcgggatggggcggttgcagccgctgttcgaaatcagcgacgccgaaaacatcatcgtggtgggtaaccatgaggtggttgtcgaccacaacgatggttcccggtcaacgctgccgccggtggccgactcggatgccgagctggaatcccagatcgcccggatggcgaggaatgcgaccccgcggcgagccttcgacgccgatcacaccgatgtgacgatcatgcaccaacagaagttccgtatccacgcgatctcagcggaagtgtcattgcaaccgtcggtggtcatccgccaacatttgctcacccaaatcagtctgggggacctgtcacatcgcggaatgatgccggtggaagtggcccggttcctcgatgaggcggtacaagctggcaagtccatcgtggtcgccggcgagcagggtgcaggcaagacgacgtttttacgagcgttgatccacgccattccgatgcgggagcggttcgccacgttggagaccgatcaggagttgttcgctcatctgatgcctggccgggaaaacacgctggtgctgttcgcccgtgatggtaacggcgaggtggatccggcgactggcacccagcacggcgctatcgagatcgcccagctgattcctcctagcctgcgccaggcgttaactagggtcattgtcggtgaggtgcgcggcaatgaggcctcggccatgttccaggccatgcagtcgggtacaggcaccatgagcagtatccactccccgcgagcctctgaggtgccgtcccggctagcccaaatgatttcgatgggcccggtctacgatctggatcaggccatgctgcagatcggtcattcgatcgactacatcgtctttgttcgtaagcgtgacctgcctgatgggagccggctgcgatttgttgagcagatccgttcagtctcgcctggtgattcgacaactcccagtcttggcgaggtgtacacggctgactcgtggacaggccagccgcttacgccactcatgcctggttcggccgccgatgagctgtctcatttcgcccgagacctggattactgcgaggcccactcatgaacactcccgcactaaccagcgccctcatcgtgaccgggctagggctgatcctgaccatcgacgggctggtcccggcgccgcctcgacctggtgccccgctgagcccggcccaaaggtgggctcggctcacccaccgtcccactggtgcggccgggcgtcgccgggatttgcgttgggggttggctgttcttgtcggtgtcgtgttgtttgtgctcaccgggtgggtggctgcgctggcgctgggccccatcattgtgttgttggcccccaccctgctgggggcggccccaccgaccgatattccgctgatggaggcgctggatcggtgggtgcgtcaggtggctgcggtgctgccacaggggcgagacatcatcacagcggtgcggatctcacggccgcgggccccgaagctgatcgccgggtcggtggatcaactggtgtcccggttggatggccgtatggagccgagggaggcgttccagcggatggccgacgagctggactcggctgaggctgacgcggtgctggcctctctggcgttggcggccactcatccgcggggagcctcgacaacgttgaaggctattgctggcaacatccaacagcggttgaaagtgctgcggcaggtggaggctgagcggtctaagccgcgtaactcggtgcgccagatcacactggtcacgatcgccatgttcggggggctgctcgtgatcggacggtcgtttctggccccgctggcgacccctcccggtcaggtgctggtggccgtggcggtggtcatgtatgtcatcgcactagtgcagatgtatcggatggcgcggccccgtcgacgcacccggatcatggtcaggaggacccgatgaccattactgctttgtccctgctagccggggccatcgtcactgtcggactgctggtcatcgtggcagcattccgcccagccccaggccctgacctggttgccgctctggaggtggtgtcgggtcgcacctcaagcgtcgccgagaacgtcgaccagacccggatcgggcggataggtcgcagcgtgacccgcacattccatgtgtcggtgtccccggccatgcgggccgcactgcgactccaaggcacgacccccgaagcgttctacggtcgacgcctgatctgcgcactgatcggggcgatcctgccgtggctgctcaacgcggtagccatcgcggtaggggcgaattccccgaacctactcatcccttcggcgctgtgtgtggcgttagctggcgctggatggatgctgccggcagcacggttgaaggctgcggccgggcccaccaacgatgactcgttcgaagcgctgctggtattcatcgatttggtcgtgctggaacggctcgccaacgaaacctccgtcgacgcgctcaccaatgcggcaaacatgtcggactcgccgctattcgtccagatccgtcaagtcctcaaccgtgcctccctggaaaacgtcgacccgtggaacgggctagaccggctagccgaggacatcaaactgcccgaactcaccgatgtggtctccatcgcccgcctccaaaacgaaggcgcctccctcgtcgacagtttccgggcccgagtcgccgagttacgcgacgcctacctgctgcgcctgcaacaagaatccaccacgatcacccagcggcttggtttgtggacgatcctgcaagccggctcggtcatgctcatcttgctgggggcggccgccctcacactcatcacagccggataaaccgacaccgtgtcgagcccccatatgggccgcgaacctttcataatgatgcctgtaagcaccacaatattgatcacaacctaacaatgaaggagaaatcatgatgaccgatctcgacctggctaaaaaacagatcacctggctggcggcgcacctgcgttcccggatcgttgacgagcgtggcggtggtagctctaccgtggagacactgatttggattggtgtcatcgtggcgctggtgattggtgtgggcgtcggggtgacggcctatatcaggtcgaagatgcctcactgacgacgatgcgtagcaggttcacaactgatcagcgtggcggtggtagcgcgtcgatggggatgctcctgctgatgcctgcgatcatgctgctggcattcggtgggatcgaggtcgggatgtggtgtcacgcccatcagtcgaccatcgcggcagcccaaagcgccgcggaggctcagcgtgtcgtccatccagctccggggtcggcacaggaggcagcctcgcagatcactagtcatggcggggtgcgtgatacccggatatcggtcagtgatgacggggccactgtcacggtgaccgtggtgggccgggccccatcgatgctggggctgcatcttccggctgtgtcgtcgacagcgtcgatgcccaaggagcgcctgtcgtgaggcgaagtgagcgcggcggagcaagtctaagcgtcgaggtgctcatgtgggcgccgatcgcgctggtgatcatcgggtttgttgtgggtatcggccggatgtcgatggcccaggacgcggtgagtggcgcggctggtgctgcggcccgtgcggcgtcgttggagcgtgatggacagtcggctcagtctgcggcgcagcaggcggcgtcggcgaacctgtcgtccggtgggctggcatgtgcgccgagtgtgagcgtggacacgtcagtgtttgcccgtcctgccgggcaggcgggcacggttcacgccacggtcacgtgtgtcacctcgctgggtcttggattcgggtcccggacggtgcacgcaacggggtctgccccggtagacacctatcgggaaaggagaggctgagatggcccgcgatgagcgtggtggcggctcggtgtcggtgtggatgctgctcatggtgccagtaattctggtcatggccggcctggtttttgacgggtcccgtcagatatcggcaacccaggcggcccaggacgcggcggttgcggcatcccgcgccggaactgatgcggcagcgacaccgcagctagctggccacgacggggcggccgtagcagtccaagcggcccgccaggcactatctgctgccggggtggacgggtcggtgcaggaggacgggtcgaccatcacggtgaccacgtctcaaagtcggccgacagtgttcctgtcagcgatcggaatcagccaggtgaccgggcatgggcaggcccatgctcagcttgtgggaccgggagaacgcccatgacagtgatacgtcgtatcggtgccctggtggcactgctggtggtgatagccggcttaccggccgggctcgtggccgcaggcgccccgctagtaccctcgggcctgtcatgggcccatgtgcggcatctgttggttaccccagacatgaccgggtcggtgctggtgtggctggtcagcctcatcggctggatcgggtgggcatggttcgccctggccgtcgcagccgaagcggtgacgatgctctcagggcagcggctgcactggcacatgcccggccctcgcctagtgcgccgagtggcagccggtctcctcattgccgcgttcgcgggcgcaccggcggccacgtcggcagctcacgcggtcgaggccacccatgtggcggtcgcagctcaggcttccccggcccacgcggccggcacccaggacagccccgccaccacctctcaggccccggacgcctccaccactccgaaaatctggaagacctacacggtgcgggccaacgactacctgtggaagatcgccgagcactactacggtgacg

SEQ ID NO: 190 - DNA, 13200 bp, Propionibacterium acnes
aacaacaccgaaccgttccaacccgccctgttcgagctggccgactgcgcatgaggaccctgcacagacgtgattaaatcgaagggctcaaccagtcatcaggagtcccccgtgcgtttgtaccgcgctgttctcgccgacaccgacatccatatcaccatccgtatctggaacactaccgatcgtgactggacctgggccccccttgacacttgggcccccgacccggccccgaccacaccagcccagttagccgatgaacttcaccgtcacggatggatcacccctgaggtccctactaccctcaccgaggtggctgtcatccccgagaactggcaagctttcgtcgagcatgccctcgctgtccggaaccagcaggctgaccaattgcgcgtcgccgagaacatcctcaccgacatcctcggcgacgccgccgacgccggcctgtctgtcaccgctctcgcccgcacgaccggactatcccgagtcgccgtctacaaacgcagcgccaaaaccatcgactccatgagacacgccacccaggccggcggaatcctcaccccctcctgtctcacccacgctgagagaacagcgctcggcctgcccgacgagtaacccatcgtttacatcctcgactggtccctgcgaccagtgaaccgtgcccccactgcgcccacaatgatcagcacacccacggcgatcatcaggtgggcagcactaactgatcccaacgaaccaagatcaaacaagccctgcccgggagcgtcgagcagtccgtgggcgcgaagccatgctccgagattgccaatgatcttggggatcatcttgttcagtagggctatccctccgatgccgacaacgaggaagacgaggatttcttcgcctgcgttgtttcttcctgtgtttgcggtcatgctgccttctcggggtggatggccagccagctgatgaggttgtcggtgatctgccctgagatttggatcagttcgacttgcccggcctgccatgcccgcgatgtgccggccagcaatgatgctgggacccctactgcgcggccacgggatgcaacctcagccaaggcggcgcgtaactcctcgacggtgctttcgatgtaccaactgccgtcagtactagtctcagcggcatcggtggtagcgataagagcatcggtgaggtcgtcgacggcgcggtccagatcagcgatgtccggtagggctacaggagtcatggtgtgtcttccttctagggtgccttcactggtgaagggtccctagccccggccgatgtgcggtgctgtgggaaaaatgcttcccattggtccgtcttagttaggaaacttggcctaagtgctgtcgagggtcgcgtgttcgtgaccggttcgaagacactgccgccttgtcttcttgcccgtggcgcttccgagatggtcagtgggcgatggctaggccgatgagggcgccgctgcacaggctgggcgcccagggaaggaatcgggtggtgtggtgtcggaaccggtcgattagggcatatagggcgatcagggtgaggccggctatgacagtgacctggatcgtgtcgatgccggttgctgcggccggggctgcccacagtggtgtgatgcgcacatcagagaaaccgaatccgcctcgggagatgagccaggcgatcatccacgctgcgaagatgatggcggtagcgatgacagcacgtatcgccgcagtatggtccgagagggcggtaacgactacagccccgatccatccggcccatccggtccacgctaggactgccggtatccatgtggtgatggcgtcaatgacggcaacccatgccccgatggtggctagcagagcccaggccggccaggtgggtgctggggcccacgctacggcggcgatcatggttgtcgcagatgcagcacagacagcgatcaagcttcggaggctgtaggtgtcgcggtagacgatcttgtcgggattggcggtagctggttctggcaggacgcgggtgagggcaggccatcctgcgaccgcaatagccgcgacggcgaccacccacacaatctgttgcatgggtctcatcatggcccatcatcgatgagtatgggtggccgacatggggtcactcgtagaggggatcgaggggtgtgcgggcgagcatggcttcctgtgtgccgagcatgagggtgccagaatcctcgccagccgattcccagtcgacgatgacctggtcgccgtcaacgctggattcggcgatggtcacccattctccgtcgatattgatgagcaccccagcggccagctccgtggcagcaaccgggtgaggtgggttgtagaagcggtcgatgtcgcaggcagggtcgtcgggttcctcgactaccggaggtggggtcgatctggctgtctcggtgtcgtcggccaggtcggctcccaggatgcgctcccattcggggctggttttcttgcccgctgaggccatcgtctcgtcgatctgttcgtcagtgggccacacaaatttctttttggtccaggtcgtggtgtcgggtcgcagctgatccagcagttccaggtcttgcggggagtgggccttgcgggggtcgggggtgtagaagaattggacttccttgggggctgattcgccggataggtaggtgccgcggccgcgtttgccgaacgggatgcccacgccgacgtgttcggagccgaacatcatgcgggctccgtcagcggacaggggtccggtggcggcacgcccggagaagttgtctcggatttcgccgcccaggaactcggcgtcggggcgttgggtccccagatcgacgtggatacggcaggcggctgccatgcgcagcagggagccgatccagccgaaaacggggcattctccgggcatcccagagaccttgatcgttgaccaccagtttttcgcgttgccgtagaactggcggtactcgtcgatgaggaccagcacgcgggtgaagtcggtctcgcgggccccttcttcttcgatgcggcggtagcggtcctccatgagagaccacagccagtggatgagggcgacctggtcggggacggtagtggcgaccatctcgatgttgggccactcccgcaggcccaggtactcgatgcgtttagggtcgatgacgaagacgcgccagttgcggcgggcaccctcgacggcgtcgccgatcatggacaccgtttttccggtacgggtgcggccggccttgagctggtgggccatgacaccggagatgtcccagaaacaggtgttgccgtcctcgtcgacggcctgggggattttctcccagtctggggagtctgggcccggaagggccacgggtcggggcaccatcgagggcagggggtggcggcgggtgacggtgatggtgtcgtgttccaggtcgaagtcgctgcgccactggccgagcatcatcgccgaggtcaccgcggccaggcgcaattggatgttcgggctggacaaatgggcgccacgttggtggtgaatggtgaagccgtccaggttcccccgatcggttttccaggaatcgacggtgaccgccgacccatagatctgagtggctacttctttagcccgttccttgtctcggtccagatcggttttgtcagggtcaggggtcggggcgcggtattgcaggacgaaccggccggccgggatcgttgcggatgtcaccgtgaactctgccggcgaccaggcagccgcggccgcctgggtgagggccattggcatggtctcgacggcagcctcctcgggggggatggtgagggtcaggcgtcgcggatgcgtcttcttgcgattccatgtgactttctgcctcaccggcaccttcgccgccgactgaatggctaggcgagctgattcggcagtttcggtacgccggccagcgcgtagcgcccgtcgtgcgtgaaggctgcccaccacagcacagcccatacacggcagccacgagcgcggatcagcggctgctgcatagcccccggtagctagtaccgcacctgaccagccggccgcgatacttttccacgccggtttcgcgccaccaggaccagcgttatggacggtctgcttcgaggctgcggagggacgagacagcggagtgctggtcatgccgcggcctccttgtggcaggtcatttcacaggcatgccggccagcgatgatgccgtggcgcaccgccccggtagccgcatagaccgcgcacaactcaaacacggggcacccatcgcaggccgccgggttcatgctttctttgtcccacgatggtgggtcatcggtgcacggcacggccaggccatcctgttgagcggcgctgatagcggtgaataggcgcagctgggcgcgaacttggtctggggtcaggttgacggtgcgggctacacgcatggggttccttcctcttcaccagtgaaggttccctagacccggccgatgtgcggagggatttcagtgttttatcgaggtgaccagccagccggtctgcgctgcgggttcaggtaccagggtcagatgcagcatggtgtggtcggctaggggcacggcgaccaggggcccgtcggcgctcgccccggtgagggtgggagttccggccacggtggtggcgggaatctggttgggtttcgcggccatcagggagcccatgagggtcggggcggcgatctggacgagggcgactttgcgggcggcgggatcgcgggtcaaccagccgcgggtgaaggtgagcgcagccgacgtgatatcggggctcagcggggctggtgtggcggcggggtgggccgttgaggagggccatacgcgcggtagcgctggcgacatcgagcgggtcggagtggggtcaggtgtggggcttagggtccgatgtggcgatggggctaccgccccggtggtgggagacgagactggttgggggtggtgttgagggcgtgggatcagggtgaaggcagccaaactggccgggatgaggatgacggccgcgccgacacttcggagcgaggtcatgtgacgatccttcggtagctcgacgggttgccgtagatcttttccacgttgatgccactatgtgggttgtcggcgctaaccatttggcctccaccgatgtagacggccacgtggtgggcagggcttccccagaggatgaggtcgccgactttgagctggtcacgggccaccgcggtgccgactttctgctggtcggcggcggtgcggggaaggctaatgccgatacgccggtacagcgccgaggtcaggcctgagcagtcgtagccgccatcggctttgccgttgccaccccacacgtaggcgtaggagttgttgtcggcgatcgatttggcccatgccacggcttcggccaggttcttcgacacaccggtctcgttagcggccccggtggcacagttgtttgacaggtgccctgtagtagtggatcccactatttgtttggccatggtttcccatttggcgtaggcatcgggcagggctgagccttgcactgcctgagctgcctgcgtcagcggcatcttctgccagtcagcgatgtcgactaaaccgggaatgtggaatccagggccgccggccgatccggggccagcgtaggtgatggtgtggcctttcaagaacgcctcggtggcgtaggcatcattgttgacctgatccagagtcccgtaccagcccggcaggatgcgctgctgaaaggggccggcgtcaccgtcaccgttagccttcgctgaggtagggtcggccccaagatctgattcttgtttggcggtcataatagcgatgaccgctgcctgggtaggcagtttgtcacgctggaccacagtgacgatggtggtcacgagctgcttctgcctggccgtgaggcctccggcacccacagtgcctccggtgacggtacccacgcaagcatccccgccgacactgccaccgccgacgccagagttgtcgtcgagggccccagagcctactgacagcagcggcacaatgatcacggtcgcgggcaagaccgccaggcccgccagcatcagcactgctgcactcaccacggcgatcacgtgagatgctttcaacgctgcccacctttcgctggtttgagggggcgacgcctgctggtacgcacaggcttggttggtccagtccgccgttggttggcaggcctgggtttgatcggcttgctgggacccggtttgggctccggagtcttaggctccggcttcacatgcctaggcacttcggctgcggtgggaggagtcagcacgtggcgtaccggcttggtgaccttctgggcacccgaaacaaccggcttagacaccaccttggcacctttgaccaccggtgcggctgccttcgcgccggccttcttgactgcacgatgcgctttgatagccccggcctcggcccggccaaccctgctagcagtagcatcgagggctctgtggcccgtcgttgccctcaccggtgcatccttgccctggcgggtctgcttagcgatcgccgacatgccgcctcgcaatgccgaaacatgattgtgggcgtgggcgatcgccgacatgccggccgtcgcgatttttgactggccctgcggggcccctgccccagcacgaatctgctggtaagccgccgacgtgccacgagcacccgccgccattcgcgccaccttcgcagccctagtcactcccgtcgacacgccacccgtggctaccgcagcagcacccgagaccacagtcgaggccatccgccttcgacccaatccggtgagcttgcgaccaccgctgcgcaccatccggcgagcaccccgcccagcccactggccgatcaccgagcccctttcggaacgcttgctgcgcatccaatcgttgatcttgtccctcagccccttctcgcccttgtgacgacgccacatggacatcaagaacccgataatccccacgagctcgagcatgttgacaaccatgaccttgatggcgacatcaccgtcagaggcgaaaaccgacttgatgatgagcatgaccacacccaacatcaccatcgacccgacaatgccgatcatcgagtacaagatcgaacacagatcccggatgagcggatctgtgcggccagggatagcccgcaacacgttgagcatcgacatgaacgccgaccacaccaacttgcacacgtagaaccagcacatgcccgcgaacaccagcaggaccacagccaaacccgccaccgtcgacgagtaaaagaagaaccccaccaaccacgaaccatccgcaatatcgccggcgtaatccgacaacccctcatcacagtcaccaaggtcgtcgcgagcatccgagacgtcatcgtaagggccacccttgagcacctcgatgtacttgtcgtggcacttcgcatcaataatgcggccatagttgagctgctgatgaaccggcgccacgaacgagtccacaatgatcgccgacagcttcggatccttcgagtctcccgtcgaggtcatgtcatcaggaatctcgacctcaccagcggtcgccgtcgcaggatcaaccgaactggtaatcatatgagacagcgccacaccgaactgctgggtgcgagccagcggagtagccaacgtcgtcgtatcgcctgcgaacttcgccaccggggccgccaagaaacccaacgccagcgccgcagcaatcgccgcacgcgcacccgtagcccacgcccctgccgtacgtcccctcatcatcttgacgaccacgcccacaccggcgcacgtcgtcagcaacgtcaacaccgttccaccccagctgtccgctcccagcggggccaaaaccttgtcgtggatgtcgttctgtaaccccaccagcggtccggtaatccacccgacccagctcatcgccacggtccagtccaacaaccggcacaacagggcaatgaccatcaggtacgtgttccaacacatgccaataatggaggcccacatagccttcagcggggccgtaacgccaccatcgtccatcgacatctggtactgaaacaagtgaataccgttggagtcagtcacattgaaaccgtcacccatccagcccagccccgggcccgatgccatggcaggcacactgctcagcgccaccaccagaaccagcgtggtgacgatgatacggaaccgccgctccccggccccggggcggcgtggatgacggctcacgctgtctcctggtcgtgctcgggcgggttggagctggcggcttcgcggtggggagcgtaggcaggtctcagtagtcgaatttcaccgacgttgccgtgttggtcggcgtacaggccacaaccggggcctccggggttgagggcaatcttgaccaggtcagcgaactcttcaggggacgttttagggtccacgcccaggaactcgacacctttctgggcgaggttgatgttgtcgcacagcaacacgatgcgatgctgaatgaggttgcggacggtctcgttggggtaatcggcctcggggtcgtgggagccggtgataagccaggcattggctcggcgggattcgcgcacgtactcgtcaatggcgtgggaggcttccggcgaggacgacatgtgatgaaactcgtcaacaatgaaagcggcgtcgcgggcccggtcgctgaagcacaccaggcgagccagacgggcaatgagcgcgtagagggctcggccaaacaccttgtgcgggggcagctgccgaaacagatgttctgacagcatctcctcggcgttaggaagagcgatgccacaagtgccaatgatgaggatgtcggcactcaggtcggcgggaggaaggtccgggtcaaagatggccgaagctagggaggccgagttctcgatgtcagcgaacacggcaatcctgtcagcgatcgcggtggcctcgggaaggtcgcactcctcggccaggtggcgggccaaacgcccacacgaggtgatctggtggtcacgcatgtaggccggtttgaggaccttggccagcgtggtcccggccacaccgatggtctccaagttaagcaaggtcagcaagaacgactgggcgacctgcccggccatctccgggggaaggatgcgcagcgggtccagcgacagcttggggtgggccgtgtcgacgatctggcgtctaaccccgtcgatagagttgacaaaggttacccactcccgctcatcggagttgtcggtggcaataatgcgcccgccccgggccgcgatggctgcgcacagccgcttctcggccatcgtcttgcccgcgcccatcttgccgatgaacgccaccgtgttgcctttctgatcctgagtgtcggcatgcaaatcgaggtaggccagcgactgcaacggggagcctgtgaccacagccaacgggatgccggtggtacggcccaaccggtactcaaccaccgggatagatgcggcgaacgcggaggcgtgagtcagctgacggtaggcgttaagcgaggaggagaaccggccaccgggccgggcagcccacagcaagtcctcctgacggcccacgggacgcacccacgtgaagtcaccgaacaccggatcattgacgaacgctcctgccagctcctcggtggtctcaaagtcaggagacgagacagtgacggtgataagagcctggatctcgacctcacgctcatcggcggccagctcggcgttgtagtcgacgagcacctgagcggaatgctcgatagacatgagggtcgaagcctgggtcatctcaccgccctcgacgttgtcgagctgatcgaccgtttgacggatagcccgctgatttttctgcatcgcagcgtgacgggtccgggccactccccggatcgccacgtcgaccggcacgccagtgtcgtcgatacggcccaaaaactcgtaggcaggccacgtcatcgtgcggggcaccttacccagcacgatatgggactggtagacggtctcgccggtgtcggcaccgattttgaggacgcgacgattccacgcctgagccgtccgggacatgtgggagactcgcttgtcatcctcgctggccagcaggtcggaggtcgcggcctcatcgatgaccaactcccccagcgcggcacgtccaacctcatccatgagggcgattccctcgccaggggcatcatcacgcaaccgggtcgggtggcctgacaggtgctgccgaagccagatctgttcatcaacggtgaccgggcggggttggaacgctgccggcagtttcgcaccgaattccttagcctgacggagggcccactcccgtgcgacacggccaggagcggtggtcatgagtccggcggcttcggtgattttgttgagggcggcggtccaggcggtgtgggtgcgtattttctggtcttggttgagtttgatcgataggaaccacacgcgccggcctagggattcggtttcaggctggtcgagggtggcgtcgatttcgtcggcccacacggggtgttcgctcaggtcaaggccggcggccatggcgtcgacgatttctgtggggtcggtccaggtgagggctccgttgaggcagaactcgtggcgggcgaggtggcggaataggtcgcggtgagctgcggcgacggtgagggaggcgttctcggtgacgggtcgctggaggggagtgagtcgccaggtggcccagatgtcgccggtggaggtccagacgaggttgtcgaagaggaaccgttcggggatggacatcatgactccttttcggcggcggcgaggaaggcttccaggccgctgcggcgtacagcgttcccggtagggtgcaggggttttctgggggtgggttcagatttcgaatgtgggaggggtttgtggatggtatcggtgtcctcggcgagggcttggtcgagcaggcaggtggccggggtgtcggtagtctcgtccagctcgtcgatcatctcgtcgaggaggttgggggtggtggatgcggcccacacaggtgggatagccggtgcgggtcgaggcggtgtggggaggcggagtttggtttggccccagaggggtgtgtgggtcatgccggcgggagtggtggcggcgtgagtggtcacacgccaccagcccgccagccatgccagaggtgaccaggtccagtcgatgcgaccaacaacgaactgggcgagccatccggcagccagcgcgaaaatgaaaccgcggatggtcatgcccccgtcgataattttgaagcccatcatcgcggcaggaactacgccgccgacagcgagcacctgatagatcgtgtagggcccgccaggaatccttcgacctgaggaatccttaccgataatgcggggctgctggcgggcctcggtgtgccactgaatatccacgatcagctcttgcccaatccttgcatcatctgtccgaagaattggatcgcgttaccttcgataagccagtgcgccataccacacacaaacagcatggagacgatcttggccaggctcataccgtgtttgaagatgttgaacgcggcaatgcccacgactacgaccatggcgacggctcgcaccgcggactgaccttcacctgccttgatcgtcgtccattcgaagaggttctgcgattccagtggcagcaggaggaattgatcgagcatgagaggttttcctttcaggaagccgaccgggatggtcccggtactgacgggctggacggcacgggtgtgccggccaggggcagaaggcgtgacggctggtcgagggaggcaacctcccagcggcctgcacggctgacaagagtcaggccgtactggctggtccgggtagtggattcgtcgccggtgggctggcatgtcacggtcaccgtgacggtaatcttctgccggtctgagggggtggggacctcgtcaggtcccaccacatgagtggttttcactgatacgcatggggctgggtcaaccgcggtgaaagcggtccctgggctgctccatctcgacaggtcggtattcccggtcagcatggcggttaggaagcctgaagaggcttgggcggccgggtcggcggtgcgaagctccgaggtgtctagggtgggggctgaggccggtgcaggcatggggatctgtccaggtagacgcaaggcgatggccttgccgttggaatcgacgtggaccgggactgaccaggcctgtccgctcccggattggccgcccatggtgaccacggtgacctgccacaggctcggatcagacggggagacggtagcgtcataggcggtgacggtggtgggcgctggaccaggtttgcggggcatgcgcgcatcggtgatcttggccgccaccaggtgttccagattgtccaagtgcccggagtcagaggtcagcagaagagtagtcacctcgaccgcggtggctgaggcgatctgagctgtgcggcggtcgtgatgggtggtgtcagtgctgacagctgtggtgggagcggatgccggggccgccgaacggaccagggcaacggggccgcatgcgactccgcacagcacgagggcaaggaagcctttggtggccatcgatccggtgtggggccagggacccacgttttcctgtgcctgttttttcttggccgaccaacggcgggacttagggttagcggatgcaccttctggggtgcatgctcgtctcaatcgcatcggtcacctccttcactggatgaagggaccaaggaggtgaccgatgtgcggtcgaacccgaaaaagttcaaacttttttctgggtctgcctcaagtacgacagaaggcctgcatcatcacggcgttgtggtagcagatcttgcgtcagcgcaaatgtatgggcctcgtaggagtagctcttaggtgggtcccggtggttgcggccagggcgagggtgtcgggtatgtgtagcgctagtcccgggttcgtggtgtgagggcttttgggtgctgacatgcactacccattgctagacgctgtgctgtggcatggctggacgtctagcagacgggttgacatcacctttaggctggcagcgcccgaggccgcaggccagaggaagcggacagcctaacgattgacgtccccctctcctttccccaacctcctggagtcgatgacccggagatagatcgatgtctatgcatctgtgcatcgatatacctatgtatctgtctgtggtttttagaggccactcccgtcgccccgggccgctcagcgataccgcaaggctgtgtgggatcag

SEQ ID NO: 191 - DNA, 8556 bp, Propionibacterium acnes
tgacagcataacgggcctgcccttgaagggttggactctgcacccatttcagccgggtacgttgccggctgggcgaaggaagcagacggcgccgcgattgaagctgccgccgagcacgtcgcgaagacctcccacgcgattgccgaggcgttgcagctcaccgcacagtgagccccacggggcgaccggctcaccccggtcgcccctcaccccccgacaggggaaccgttcccgccgcctgaatctccatacccctgatacgtactacgcggggtcgaggagtggactcccccaccctcgtgtagtacactatactacacagtcattgaggatagaggtgacgtcatgagtttttcgatccgtttaaccgaccatgagcgccgcttagctgattcctacgcccgcctgcactcgcagtccctgagtgaggctttcaagcaagccctcttcgaccgcatcgccgacgagttcgatctgcaagtagcccgtgaggcactcaccgactacgcccgcgacaactaccagtctcgccccatcagcgagctatgggacgagtgtgacctatgagctggcagatcgaaaccacgagccggttcgataaagaattcaaaaagctagaccgctacacccaaaaactcattcacggctggatcacgaaaaacatcgacaacaccgacgatccccgccgccacggcaagcccctcaccggtgatctttccggactgtggcgctaccgcatcggcgactaccgcctcatctgcacactcaacgataaccgcctcaccatcctcgccctgtccatcggtcaccgccgcgacatctaccgataagccgttgcaagactgcggcgtcgacaccgccgggaccctggcccaggccttgggcctggaggaggacgagagcgaggagcacgccgcctgagcggtcgccggcacttcccataacagcaccggtcccggcggcccggccccgcgtctggtgctcggaccgatgccggcgcctggcctccgacgcccgccggggccagcggctgggctacctcgacgtcgacgtacaacgggccgaacgaaccgtgcgctgatttaccaccgcttccgcacagagaacatgcctctgactaggagaaatgacgttttccacagggcctctattactaatatccctattatctctatccacgcgcgcgagcctcagcgttcaagcttcaggtcttgctcgtctccctcgcgcctcgctgcgctcgttgctactgccgccccacccggcaagccgggtgggttgccatcggaataccgtggaccatcccggcgcatacacccagacggtccaagatccaatccacgctcacccgcgacgccgctaacgatcctcatacaccgtagatgccgttctgagagccttccagacccgcacgtgggtttattgcaccgagacccaaatcccctcagaagcgatcctgaaaccgtctacgccccatttccgacggacgctggacaggctgggcggcttgtctcccgccgcagacatggccctggcatatgcggttgccgactggtgggatcagggattggatcacacggcagacggctggtccaaggcgggtgtgcaggtgcggtgagcggcagacgtgaccggtggggtgcactgtcatggccgggcatctgccgagccaccatgcgggccctggaccaggaggcagcccgctgcgaggactgggggaagacggcggcacggatgggccgtcgggatgcggcggccgaattcaccgagactgcggtgcagcatcgtggacagatgcaccacctcatgtcggcacaaaaagtgtgggtgtcgaccgacatggtgtcggctacactggacgccgcaggagacgtgccgagtttcgaggccgtcgacgtccctgccgccgggctcatgggtttggccagccccctgccgccggttaccctgcagcatccgctgtatctgcgcagcgacgagggtgtgacaaccttcactgatccggttctcgtcgacgcgctgggatggtggatggattctgggcgtgtgcacgtggtgatgtgcacacgcacaccccggctgcccaacccggtttatgcggtggcctccccactgacggtggtggagaaaatcacggtgcccaccggcatcgagttcgagaccatggagtccaggatcctgacccccggcggcgtgacaggcgtctcacggcagggcacacgcatgatgatccggttggcgtcatggctgggtgccgcgtgggtgctcatggcgactccgacggtgtcggagccgcaccctatggatggccggtggggaggcccagcaacggggcagacccggccgcgtgatcgggtgaccgtggtcgacatgcggcccatgaggcaggtgcacaccaccaccgaccccaccggcaggcggttgacgacccggcatgtcgtgcgaggacactggacacaccaaccctacggcccggcccgcagtctccgacgcctgcagtgggtcgccccattcatccgcggccccgaaggggctccgttcgtcggcaccgacaccgtcaccgtatggcgccgctagatacgcgggcgcggggggttgacgaacgatgcccccctctttgtgttgtgatcagtcgtgatcggcgggttttaggtcggggtaggtgtcgagaatggccttgaggacgaggtcttggattgtggtgtcattctgggctgccttgaccttcagtccaacgccgatgtcccgggggattctggtctgcaacttgaacaggtctgcctccttggttttgaacagtttggctgcagggttggcaacgggctgttcttggcgctggcgtccaaggttgcttttctttcgggcggtcatgacatcatctccaacagttcgtcggcaacatcggcgaagaaggcgatagtttccggctcaggggtacagccgtaggcgcgcttgatgacttgacgcttggggatgacgtgatcgaccaactgcgtctgggagtcgttggctagaaggtcgcgaccttccttgaacagggaggtattcggttcagctttggaaagcagcaccacgcgcggggttcctgcggcggcgtcgtgcgtctcccaggtgcgcgccatgtcgagcccggacgtgtcggtggggatgataaccagatcggcggcgcgaatggcggcggtgatgatgtcaccgttgcccggcggggtgtcaatgatgacaacttcttcgggtccggcgacgaggtgctggagcgtcgccttgttggccggttccacggggaaccccaaggggtcggcgttactcagtgtgcactcggcccaggatgatgctgacccttgagggtcggcatctttgacgcggaccatacggcccgtctcatggagagctgcagccagcaggatcgctgccgtggtcttaccgacgccacccttggcgttgataatgctccagatcatggtgacacctttcagtgaggatgcatatcagtttacctgcaaggagtaaagacggcaagcagttatgccgtttctgcggcaagccgtcttgcatccttggatgtatagatagttgtctacttatggttgtggatcgtggtgtctcgtaccaggatttagtgtgctcgctgatatgcacgactttcgggcggcctgatctggcggtggtgccactaacccaggagtctgatccgcaaggtgtcctcgactttgaggaaggggtctctgctttcgtgttgacctaaagtcaacggccctgggcgatcactgaatcctaataactttgtatccttccctgattgcatcttagcatccttgaattcaaacagggatggagccatgctgttttgacgacatggatgcactggggtttggttgttgccgatgcggagcgtcaggcggcccgggacgccgccaccgccgacacgctgcgggagatcgtgggactgctgggccggggcggcgaggtcccgcccgccaagacggggcgtaagacgaccggcaggccggccccggcccgcaagtcgtcggccacgcagtaaaggcagggatccgtccctacgcagagagcggaggcagatcctgggggatccgactcttcggttccgtgatcttcccggagatcttcccggatcccccagggctcatcctgatacggggtccgccgacggaccccgtatcagtgggggcgctgccaccagtgatggcgggcgggtcggtcggcgtctaggccccgcccgatggtcgcctggtctacctcgcaggcccgtgctgttgccgaggccgagaacgtctgcccacttgttgccgattcagtcccctctccgtctgccatgtcgccaacctttcctatctggcgtgctcatggacatgcccgggcacgccctcgctgctcagaggcctgctcgttccacctctggccgcgaaccgtatttctgctgaccactcctcgtgcgtgaatatttgccagccttggccattcatatttggactactctgcaccagatatcggactgggaaacctcttgcacatctctaattgtcatctattcgttgggcgcgcgctgttagatcgtgatcataccaatcagaagacaaagcgacgcccttttgagcggcttttcgaacgattctagaccgcgctatatcagcatttctaccgcgcggccagagtgctacactaaattcctctctgcaatccttaagtccattctttacttcctcatccaatttctgcgacagcatttttatggaagcatcgcactctgactcatcatcaaatgcctcaattgcgtgcgttcgccattcacggcgcgtattatcgtagccgtaatgaagtattacccaccgatccacagaatcatcgttaggatctacaactgtcatgaatggcccaactctcgctctggtgtattctcaattgcagttcagtgactttacttgaccagtcccggatttagtagacgtagacggagagtaccccgccgggaacttgactgacatcactgctgtaccgtactgctttcccgggtggcaaccatcgtaagcagcatttgccgtgacgtacctagtgctctttctctgagtgccggtaatcgccttatatggtacaggtgggtgaatcgtagccgttacggctaccgatgacacgtttgcatcacatgaagctgtggcgacataattagttgtcccattgacatgatgagagtcgtggacatactgtcgaggatcgagagtgcaggttattgttgacgccgttgttctggtaccagctgctttcgagctctttgttgcagttacagtctgcggccctgaaggttttactgacgcgactgatgtgttcgcgtgttttgcggcagtgctttgatttggttgtgcttgtgtagcagttgctgatgtcgccagtgatgcccccattaccatagctgtgattatggcgtagtctttacgcttcattgcgcccccaaataagcatgttagtttgctattttgaataggaaacgagacatcgccatgacttgtcaagggcagaagtagaaagaatcggggggtatcaagaaagatgtgctttcatcaggacgaaagcggatgggtccgttcgacttggtgacgaatgatccggccttgcgtcgcggagaccaggccggcgagtttgtcgagcagggccgccgtggcctcatcgtcgggcacatcactaaagggacgaacaaccatgacggctagggccagaaacgaccggaactgaatcgcatgtggacccccatctggcaccaggcacacacctaccgaccggaaaccctgcaccctgtcgctcccagttcacctcctaatatgcgcctatagtctgtgctagtagacattattttgtgtgttgtttcccatctggcatgtctggccccggacccgccgcgacacgcggtggtggataacagaccaggacccccggaccatagagaccagggggacgagacagtcccccggtgaggatgtctcgatgtgcagatcaggaacagaatcgccgggcacgacccggcgccggtgccggtgcagtgaacccgtggcccatcgactccacgaacgaacgtctcgccttcctcaactggtgttggcggcaaggctactcagcagccatcgtggaaacgatggacgccgcgggagcctacgaccacctcgacgacgaccagaccagcaaccagcacgactaacgccgctcccagcacgggggaaggcggcgcaccaggtgcgccgccttcccccgtgctggtgtctcgtcggcttactggtgggggtcgtaggggaacccgtaggtgtgttccagggccttgcggagaaggtcgttcatagttgtgtgttcggcgacggccttcatcttcagcgccgtgtgggtggcggtgggtagcttgacgttgaacgcggtgatcggggtcttggccgactggaaggtttcagagacactggctccctggctggccgccatttggtcggcgtaacggctggctttgtcggcggcggtgggtttgcggttcttactcacttcagcatctccttgattcggtcggcaacctgggcgaactctcctagatctgttggccgggttccgatggcttgccgataggcgacccgtcgatgaacctccgcatcgagaacgtctaggccctcaacggcggcggccccctcgtgggcatcacggtattgcctggtccaatcggctttgttgaagagcagggcccggcgtgtgccgtgggccacctggtaggtcattagcgctcggtccatgtccaggtcccccgactcggtcgggatgatgaccacatcggcgatgtcgagggctgcggtgatcgtctgagagtcaccggggggagtgtcgatgatgacaaggtcggcgtcgatgtcacggcagcgcctgacgataggggcattagccgggcggacctcgaagcccagcgggtcaccagtctcgaaagcgtcggtagcccatgacgtcgccgatccttgcgggtcggcgtcaagcaagatgactcggtactgagctgctaaggccgttgccaggtagaccgccgtggtcgttttcccgaccccgcccttggtgttgacaatagaaatactacgcataaatacatcattacacatgtgcatcgatgtatctgtatatatgtgtatcggcgtgttgtgagggaaaacccgggccacatacaacgatcccccagccaccacagccgggggatctctcagtaaagccagcaactcccacagaagttgcacccccacgatacccaccacatccgtgtcaagcccccacaacacccaccagcgccctaggcttcccccatgaacattgacatggacacaccaaccgaaaccgaagccgacaccttcgatgccgtcctcgccgacattaaccacatcaaccgcctcaccgccgacgaaatcgagtgctactccatgggagcctgtctcctcctcctcaaccaccaccccttctccgaactccgccaacactgggccgacaaccccaccgacgaaaccacgtggaccctctacggggccatcatcgccgcctccaccctggacccccacctcagcatcgacgccctagcccgcctctaccagctccccctcgacctcgtgacccaagccctcaccgtctaagcgtcgatgagcgggggagaggtagcgcactatcggctaaggaaccccacaaacaccaaacccttgtcactgggaagggtttggtgttatgctggtctcacaactcaacagaggaggtgagacatgggaaatgagtaccagaagtcgctcaaagtcctgttcaagaaactggaatctgagcaaggagcccgcatcgagacccggcgcaaaggatggatgatctacccgccggatacgtcacgatcagcggtcatgatccacaagactccatcagatcgcagagcatgggccaacatgctttccgaactgagacgctcaggattcaccgtctaactcagtgaagggggctggagctccagccccctttcaaccacctcccccggacaccacacaagaaaaggagaacatgatgtggcacgttcggttgtcgcttcgcgcaatcagcgaggacatgctgttcgacgccctggacaccctcgaccccttatccccggtggccacactgggccccgatgagcacaccggatcattggcggtgttcgtcgaggctgactcactgacagacgccatcgagactgcccgcacagccatcaccaacgcatgcaacaccgccaccataaccggcgtagaagcccgccccgaagacgaatgcttcgcagacgttgaccggcccctgttcccgccagtggtcggatacaccgaaatcgctgaaaccgcaggactctcacgtcagcgcatccgccagctcgcaggcaccgccgggttccccgcacctgtcatcaagaccgcggccggcccgctgtttcccaaagccgccgccgagcagtgggcgcggacacgccagcctaaggcaggccgcccaaaactccagaccaccacctcataacacatcccgtgtgctgaacctgtt

SEQ ID NO: 192 - DNA, 3927 bp, Propionibacterium acnes
ttggtattggtaggcgatggtgtcaccggttttgttgcggatgacgtcgaagccttcgatgtcggaggggatgtcgtcggcgtcgtagacgacggtggtggtgacggggttggaggccgacatttggccgatggtcacgcgcagcatgtttttcaacgcggaggtgaggattgtcgtggcggtggggttcttgtctgcccagcgtttctcggcgatgtcgatcatgtcttggatggttttgacccatcctcggatgggatcgactttggtcagtttgatccctccaaggaactcgatgggcttagtaacgggcccgtcaggaccgaattcggtgtcccagccttcgtcgatggctagtttcagttcggcggcgtcaacccatgtttcgtgggtggtgccgggcacgttgggccaaaaccatcctgctcgtcctttggtgcgtttgaccggtagtaggccgatgtcgtcccaccaggatggcacggtgaagcggatgtggtagcgggccgggtgccaggggttgttggtgaacaggtcgtgagcttcggtggcgctgagcagagtggcgggtgcggcaccgatctctccggtcactgatccggcatacatgaatcggccgtcgatgtacacgaagttagggatagggccggcaggcacggtggggcgccaaccttgttcgcggtcctcggggttgccgtcgtcgacgcatagttcgtagcggtgctgaggggaggtgtgttggatgagtgcgcccagttcggggtccatcggctccatgcgataggactcgggggtccgtagcttccagaggttgattccttctgctccggggcggtccatgagggcccagtcgcggtcgattctggtggcgatgatgtgggttaattcgcgccatgcccagcgggcctggattggggtgagggtctggccagggaaccattcatcagcgaccagaatgtcgaggttgcggtcggtttctttgtgggtgaaccggcctcgggcgggccgcccggacagcatgaacaggccccgcacgtgccagtcctggttgaactcgcgggtgtgagcgggggtgtcaggcagcagccaggattgaggctggtcggggatgttaccgcagacgatcaggcgtcgggcgttgtggtgtagcgcggttgttagcaggtctgacagggtcgcgtgcttggtgcgccgcccccctagcactggcaggatctcgtttccggccgcgtcgactccccgggcggtgtcgatgtctagccacactgtttcggggtcggggggccgatgtggggcgggacggcgctgctcctggtcgtctctcatggtttcctcctttgggccagggagcggccggcgtcgagggcgttcatgcgctcgcgttgttcttcgcgtagttggtagacccggcctcgtgacactcctgctgcctcggcgatggtggtggccggcaggtggccgatggcggcagcgtcggcaaggacgtcacgccaggccaggtcaatggttcccagctgggctagagcttcgtcgcggcggcgggtggcatcagccactacggaggcccaccctgtggggtggatggtcttgacgacgattcggttgtggcggatggggccccatgcatcagcggggacttgccagccgtgattggcggcggactcggtgatcttgaggcgtcgctcaggtgcgcgggtgcgggcagtgacgtcggtgttccaggtctggactggtacccacgtcccctctcggatgcgttcgatgacgcacgtggtgacctcgtcggtgactgtgatgaccagacgataatctttcccgtctggggtggttcggtagctgggcatgtcaccctcccctatctgtcaaatgagctagacacagtgtctatttaatttgacgcaaagtcaagtgcattagacgcctttgtgtggatccgccccaccagacaaacactcgcgcctcatgacccgccgcgaagccttaacgaaaccaaaccgcttatagaaccgctccgcagcgctccccgagggctttagctccaaggtaagaccttgctcgtcggcccattggcagacttgtgtgaggatctgtgagccgtagccctgatttcggggggcggcatgcacgcacatcagcatgtgaccatgacggcgggtcggcgggctgacataagccccaccacgccagtccggtgtgatctgccaacttcgccatgccgcagcgcgccagcggcgggcctcggtagccaccatgatcaccatgatgatggacagggttacgacgccgactatggtcagctcactccagccaggccagttcccggagatgatccagcctcccagcgcccagatgatcatggcttccacgcccgccgcaatcgggacgagtggggcagtacggatgcggcctgccatgatctcggtgatctcgctgcgatgccatgacaaggagaattcccacgactcttgaatcatgctgatgtgtgaacggcttcctcggcttcgccctgccatagcttctctagacggcgctcggctagctcgtcggggcacggcgacagcctgccgcactcggagcagaccccgaagtggcgcgagagagtgatgaccggctcatcgggagcatgaaccgattcaacgaccgggtgctgctcatcggtgagtcctgaggcgtgaccaatctcggctagacggaggtgaaccataccgtcgtagtagtcgaggccttcaacgtggaacgggtaggagccgtccgcggtgtggcctgcaaccaggtccccgacttccagctgactggcggtcatggttcgcaccggcggcagcggggtccgggtcgcgttgatcctcatggtctctccttgcttctgcgccttcatagatgaaggtgccacagccggggttgatgtgcggaaccacagccactttttcaataaatccatcaccacggtctcaccccttcccaaatgtgtaaaccgtggtttacgctttaaggcatgatcgaacacacaccgacacccgccgcgcctcgcgtggccatcatttcccctagcgggccaccacggttcttggccgagcctcccagcgccgcgctgcgacgccatggtcggacccgcatgaggtcccttcccctatcccctcacattcgcgcctgggtctccaccagcggccgtaaacccaatcccatagccaccgccctgatctggatgcataccggagccctgctgccggtgtgggacaccgccgttttgactgggcctgccctcggcagacgtgtgcgccctctcagcagtgacgccgaactgacctctcggcggtggctcgaccaggttgccgaccatcccggctttctcgacacccttatcgaggccgcccgcatcaccgatggatggcatcacgcgacgcctccgcacattcaggccccttaccggacccttcatcagtgaacggaggtacaacgacatgaccagcgacattgacattgaccggacccacaaacccgacgaccgcgccgaggctcctctttaccggtcctgggccaggagactcgtgcacgtctccgggatgccctggcgtatcgtcgccgccttggccggggtctcccccacctccatgcaccggcttctattcggccgcaacggtcgacccgtggaatggatcggcatcaatgatgctcgcgccctgatggatatcggcatcgatgatctcgcctcagcgtccaccgaccgtatcccggcccgcgaatcccgcgagctgttggtagccctgcacaccctcggctggaccgatgagcatctaagccgctggctgaccagttccgacctcgacctgaccaccgcccccaaagccctctacgtcactcgactatccgccgcccgcatccaggccacctacgacatgctcatcagccagcccgtccgccgctgcggcc

SEQ ID NO: 193 - DNA, 2076 bp, Propionibacterium acnes
tggcgaaacgatcaggcgagccacgaccatcgccaagctgaatggagagcgagcatgagcaccacccctgccgggttcgacttcgacgctctggccgagtgggccgagagcgatgaggcgacccacaccccgcaaaccagccccgtgttccggggcaaggacgccgcgcgcgccagccgcgcattcctcggccgaggacggcccaccctcggctcagaccacgccaccggcgagggccggtcgccccgccgtcaggtacggctcgacgcacgcaccaacgcgcgactcgacgcctacgcagccgcaaccggcaccagcgcctcccagatcatccgcgacgccctcgctgactacctgcccgcctgatcccaccccaatccactcgggcgcctgtcagtgccccctcttctgggtggtggtccggggcgtcaccgccccggaccagttgggtagtcatctcagttgaaataagcgattagtgatacgcccctcatgctttccggtgctgtcatgagcgtctgacaacagcgacacctcggggcagccgacggacagtcctctggctgccgctctgatcccatgcccacggcacgaaggtgtcggacagctcggtctcgtcatgtgcccaaatagcgtcgtgggcctgtcgccaagcttctcgggagccccacacgggcacgaccgggccacaccggtgtcctggtctccagtgtcgcgacactgtcgatttcggtacgtgcaatgcggcggcggtttgacggatcgacatcccagactcccgcgcgtcccagatcgccatgtggagagtatttgcctccagtgcggccgccacacttgcacgctctcgcgcacgctcgaatgcccgcctagtgctctcaaatgtcgtcacgacgcctccccctgaaaatactcagggtgtcccacggtgggacaccctgagtatttcataccccaactcgcctcaccacacgtcgacctcgacaccgatcaagcgacccgtatcagcgacattgccgtaccgctgccccgcctggtcctccagccacgacaacgcatcccgaaacagcccgacgtcttccaaagctaaaccacagtcgtagccgcccttgtcccccaaccgcacaatctggcgctcccggtggcctccctcgtcgacctcgatccacagtttcgcgtgcatccgctggcctcggccctctgacaggatctcggtgagcaggtcggacgcctgccctcgcgcatcctcgttactgcgggggaattggagtatgtgggaggaacggtggtggggcaggtttgtgacctcgtgacgcagcaggttgcgcttgtgcatctgccgttcgagacgctcgggctgacctgttgacggggttgagccgtggcgccgcttcctcggcggggtctcgatccgttgctcttccggcggttcggcgtcaggttgtggtgcgcgatctcccctaggacgggggggctcgccacctatatccgagggacgatgagacggccttccacgcttgctgcgcactttcgcagcccgccccttgcggtcacatcgacgcggcggcggagtgacgtcctcaccgcgcgctaactgcgtcaacgccgccaccaggttggtgcccggtttcagccctttcagcacgaaccgcaccaggcgggggtctcggccgattcgtcgggcaatctcggcttggctccacccttcggctaacagggtgcgcaacaagtcttgggcccggttatcacgctcagtcactggtcgcctcctcggggagtcctgcctgctcggcctgctctgatagagcagcccgttccgatccggtctggggcgctttcaggggaccgggtaggacacctttgacacgcagtcgcccgtccttgccgtcgtcgccgcccccctgggccacagggagcgcccaggggggcacgttgctggtgtagatggcgtcgccgtggatagccagcagggtgcgggagttcatgcgtagtgctcctcccttggttgtggcgttttttccggtggtggggtcggcgatgggtgtgttgagggtgcgtacgcgggacagggcccagata

SEQ ID NO: 194 - DNA, 13067 bp, Propionibacterium acnes
ccgaaacgttccagcccgccctgttcgagctagccgactgcgcatgagaccccacacaaacatggttgaatcgaagggctcagccagcagccagttaccaggagtccccgtgcgtctataccgcgctgttcttacccacaccgacatccagatcaccgtccgcatctggagcaccaccgaccacgactggacctggactcccctcgacacctggacccccgacccgaccccgaccacaccagcccaactggccgacgaactccaccgacacggatggaccacccccgaggaccccaccaccctcaccaaggtgactgtgatccccgagaactggcaggccctcgtcgaccacgccctcgctgcccgaaaccaccaagccaaccagctgcgcgtcgccgagaacatcctcaccgacatcctcggcgacgccgccgacgccggcctgtctgtcaccgctctcgcccgcacgaccggactatcccgagtcgccgtctacaaacgcagcgccaaaaccatcgactccatgagacacgccacccaggccggcggaatcctcaccccctcctgtctcacccacgctgagagaacagcgctcggcctgcccgacgagtaacccatcgtttacatcctcgactggtccctgcgaccagtgaaccgtgcccccactgcgcccacaatgatcagcacacccacggcgatcatcaggtgggcagcactaactgatcccaacgaaccaagatcaaacaagccctgcccgggagcgtcgagcagtccgtgggcgcgaagccatgctccgagattgccaatgattttggggatcatcttgttcagtagggctatccctccgatgccgacaacgaggaagacgaggatttcttcgcctgcgttgtttcttcctgtgtttgcgatcatgctgccttctcggggtggatggccagccagctgatgaggttgtcggtgatctgccctgagatttggatcagttcgacttgcccggcctgccatgcccgtgatgtgccggccagcaatgatgctgggacccctactgcgcggccacgggatgcaacctcagccaaggcggcgcgtaactcctcgacggtgctttcgatgtaccaactgccgtcagtactagtctcagcggcatcggtggtagcgataagagcatcggtgaggtcgtcgacggcgcggtccagatcagcgatgtccggtagggctacaggagtcatggtgtgtcttccttctagggtgccttcactggtgaagggtccctagccccggccgatgtgcggtgctgtgggaaaaatgcttcccattggtccgtcttagttaggaaacttggcctaagtgctgtcgagggtcgcgtgttcgtgaccggttcgaagacactgccgccttgccttcttgcccgtggcgcttccgagatggggtcagtgggcgatggctaggccgatgagggcgccgctgcacaggctgggcgcccagggaaggaatcgggtggtgtggtgtcggaaccgatcgatgagggcatatagggcgatcagagtcagcccggcgatgaccgtggcgtggatcgtgtcgatgccggttgctgcggccggggctgcccacagcggtgtgatgcgcacatcagagaagccgaatccgcctcgggagatgacccagacgatcatccacgctgcgaagatgatggtggtagcgatgacagcacgtatcgccgcagtatggttcgcgagagcgatcatggccacagccccgatccatccaacccagccggtccaggcgagggctgccggtatccatgtggtgatggcgtcaatgacggcaacccatgccccgatggtggctagcagagcccaggccggccaggtgggtgctggggcccacgctacggcggcgatcatggttgtcgcagatgcagcacagacagcgatcaagcttcggagactgtaggtgtcgcggtaggcgatcttgtcggggctggcggtagctggttctggcaggatgtgggtgagggcaggccaccctgcggccgcaatagccgcgacggcgaccacccacacaatctgttgcatgggtctcatcatggcccatcaacgccgaaaatgggtggccgacatggggtcactcgtagaggggatcgaggggtgtgcgggcgagcatggcttcctgtgtgccgagcatgagggtgccagagtcgtcgccggccgattcccagtcgacgatgacctggtcgccgtcaacgctggattcggcgatggtcacccattgcccgtccatgtcgatgagcatcccggcggccagctctgtggcggcaaccgggtgggctgggctgtagaggaggtcgatgtcgcgggcagggtcgtcgggttcttcggttacctcgggtggggtcgatctggctgtctcggtgtcgtcggccaggtcggctcccaggatgcgctcccattcggggctggttttcttgcccgctgaggccatcgtctcgtcgatctgttcgtcagtgggccacacaaatttctttttggtccaggtcgtggtgtcgggtcgcagctgatccagcagttccaggtcttgcggggagtgggccttgcgggggtcgggggtgtagaagaattggacttccttgggggctgattcgccggataggtaggtgccgcggccgcgtttgccgaacgggatgcccacgccgacgtgttcggagccgaacatcatgcgggctccgtcagcggacaggggtccggtggcggcacgcccggagaagttgtctcggatttcgccgcccaggaactcggcgtcggggcgttgggtccccagatcgacgtggatacggcaggcggctgccatgcgcagcagggagccgatccagccgaaaacggggcattctccgggcatcccagagaccttgatcgttgaccaccagtttttcgcgttgccgtagaactggcggtactcgtcgatgaggaccagcacgcgggtgaagtcggtctcgcgggccccttcttcttcgatgcggcggtagcggtcctccatgagagaccacagccagtggatgagggcgacctggtcggggacggtagtggcgaccatctcgatgttgggccactcccgcaggcccaggtactcgatgcgtttagggtcgatgacgaagacgcgccagttgcggcgggcaccctcgacggcgtcgccgatcatggacaccgtttttccggtacgggtgcggccggccttgagctggtgggccatgacaccggagatgtcccagaaacaggtgttgccgtcctcgtcgacggcctgggggattttctcccagtctggggagtctgggcccggaagggccacgggtcggggcaccatcgagggcagggggtggcggcgggtgacggtgatggtgtcgtgttccaggtcgaagtcgctgcgccactggccgagcatcatcgccgaggtcaccgcggccaggcgcaattggatgttcgggctggacaaatgggcgccacgttggtggtgaatggtgaagccgtccaggttcccccgatcggttttccaggaatcgacggtgaccgccgacccatagatctgagtggctacttctttagcccgttccttgtctcggtccagatcggttttgtcagggtcaggggtcggggcgcggtattgcaggacgaaccggccggccgggatcgttgcggatgtcaccgtgaactctgccggcgaccaggcagccgcggccgcctgggtgagggccattggcatggtctcgacggcagcctcctcgggggggatggtgagggtcaggcgtcgcggatgcgtcttcttgcgattccatgtgactttctgcctcaccggcaccttcgccgccgactgaatggctaggcgagctgattcggcagtttcggtacgccggccagcgcgtagcgcccgtcgtgcgtgaaggctgcccaccacagcacagcccatacacggcagccaccagcgcggatcagcggctgctgcatagcccccggtagctagtaccgcacctgaccagccggccgcgatacttttccacgccggtttcgcgccaccaggaccagcgttatggacggtctgcttcgaggctgcggagggacgagacagcggagtgctggtcatgccgcggcctccttgtggcaggtcatttcacaggcatgccggccagcgatgatgccgtggcgcaccgccccggtagccgcatagaccgcgcacaactcaaacacggggcacccatcgcaggccgccgggttcatgctttctttgtcccacgatggtgggtcatcggtgcacggcacggccaggccatcctgttgagcggcgctgatagcggtgaataggcgcagctgggcgcgaacttggtctggggtcaggttgacggtgcgggctacacgcatggggttccttcctcttcaccagtgaaggttccctagacccggccgatgtgcggagggatttcagtgttttatcgaggtgaccagccagccggtctgcgctgcgggttcaggtaccagggtcagatgcagcatggtgtggtcggctaggggcacggcgaccaggggcccgtcggcgctcgccccggtgagggtgggagttccggccacggtggtggcgggaatctggttgggtttcgcggccatcagggagcccatgagggtcggggcggcgatctggacgagggcgactttgcgggcggcgggatcgcgggtcaaccagccgcgggtgaaggtgagcgcagccgacgtgatatcggggctcagcggggctggtgtggcggcggggtgggccgttgaggagggccatacgcgcggtagcgctggcgacatcgagcgggtcggagtggggtcaggtgtggggcttagggtccgatgtggcgatggggctaccgccccggtggtgggagacgagactggttgggggtggtgttgaggacgtgggatcagggtgaaggcagccaaactggccgggatgaggatgacggccgcgccgacacttcggagcgaggtcatgtgacgatccttcggtagctcgacgggttgccgtagatcttttccacgttgatgccactatgtgggttgtcggcgctaaccatttggcctccaccgatgtagacggccacgtggtgggcagggcttccccagaggatgaggtcgccgactttgagctggtcacgggccaccgcggtgccgactttctgctggtcggcggcggtgcggggaaggctaatgccgatacgccggtacagcgccgaggtcaggcctgagcagtcgtagccgccatcggctttgccgttgccaccccacacgtaggcgtaggagttgttgtcggcgatcgatttggcccatgccacggcttcggccaggttcttcgacacaccggtctcgttagcggccccggtggcacagttgtttgacaggtgccctgtagtagtggatcccactatttgtttggccatggtttcccatttggcgtaggcatcgggcagggctgagccttgcactgcctgagctgcctgcgtcagcggcatcttctgccagtcagcgatgtcgactaaaccgggaatgtggaatccagggccgccggccgatccggggccagcgtaggtgatggtgtggcctttcaagaacgcctcggtggcgtaggcatcattgttgacctgatccagagtcccgtaccagcccggcaggatgcgctgctgaaaggggccggcgtcaccgtcaccgttagccttcgctgaggtagggtcggccccaagatctgattcttgtttggcggtcataatagcgatgaccgctgcctgggtaggcagtttgtcacgctggaccacagtgacgatggtggtcacgagctgcttctgcctggccgtgaggcctccggcacccacagtgcctccggtgacggtacccacgcaagcatccccgccgacactgccaccgccgccgccagagttgtcgtcgagggccccagagcctactgacagcagcggcacaatgatcacggtcgcgggcaagaccgccaggcccgccagcatcagcactgctgcactcaccacggcgatcacgtgagatgctttcaacgctgcccacctttcgctggtttgagggggcgacgcctgctggtacgcacaggcttggttggtccagtccgccgttggttggcaggcctgggtttgatcggcttgctgggacccggtttgggctccggagtcttaggctccggcttcacatgcctaggcacttcggctgcggtgggaggagtcagcacgtggcgtaccggcttggtgaccttctgggcacccgaaacaaccggcttagacaccaccttggcacctttgaccaccggtgcggctgccttcgcgccggccttcttgactgcacgatgcgctttgatagccccggcctcggcccggccaaccctgctagcagtagcatcgagggctctgtggcccgtcgttgccctcaccggtgcatccttgccctggcgggtctgcttagcgatcgccgacatgccgcctcgcaatgccgaaacatgattgtgggcgtgggcgatcgccgacatgccggccgtcgcgatttttgactggccctgcggggcccctgccccagcacgaatctgctggtaagccgccgacgtgccacgagcacccgccgccattcgcgccaccttcgcagccctagtcactcccgtcgacacgccacccgtggctaccgcagcagcacccgagaccacagtcgaggccatccgccttcgacccaatccggtgagcttgcgaccaccgctgcgcaccatccggcgagcaccccgcccagcccactggccaatcgccgacgccccttcggaacgcttgctgcgcatccaatcgttgatcttgtccctcagccccttctcgcccttgtgacgacgccacatggacatcaagaacccgataatccccacgagctcgagcatgttgacaaccatgaccttgatggcgacatcaccgtcagaggcgaaaaccgacttgatgatgagcatgaccacacccaacatcaccatcgacccgacaatgccgatcatcgagtacaagatcgaacacagatcccggatgagcggatctgtgcggccagggatagcccgcaacacgttgagcatcgacatgaacgccgaccacaccaacttgcacacgtagaaccagcacatgcccgcgaacaccagcaggaccacagccaaacccgccaccgtcgacgagtaaaagaagaaccccaccaaccacgaaccatccgcaatatcgccggcgtaatccgacaacccctcatcacagtcaccaaggtcgtcgcgagcatccgagacgtcatcgtaagggccacccttgagcacctcgatgtacttgtcgtggcacttcgcatcaataatgcggccatagttgagctgctgatgaaccggcgccacgaacgagtccacaatgatcgccgacagcttcggatccttcgagtctcccgtcgaggtcatgtcatcaggaatctcgacctcaccagcggtcgccgtcgcaggatcaaccgaactggtaatcatatgagacagcgccacaccgaactgctgggtgcgagccagcggagtagccaacgtcgtcgtatcgcctgcgaacttcgccaccggggccgccaagaaacccaacgccagcgccgcagcaatcgccgcacgcgcacccgtagcccacgcccctgccgtacgtcccctcatcatcttgacgaccacgcccacaccggcgcacgtcgtcagcaacgtcaacaccgttccaccccagctgtccgctcccagcggggccaaaaccttgtcgtggatgtcgttctgtaaccccaccagcggtccggtaatccacccgacccagctcatcgccacggtccagtccaacaaccggcacaacagggcaatgaccatcaggtacgtgttccaacacatgccaataatggaggcccacatagccttcagcggggccgtaacgccaccatcgtccatcgacatctggtactgaaacaagtgaataccgttggagtcagtcacattgaaaccgtcacccatccagcccagccccgggcccgatgccatggcaggcacactgctcagcgccaccaccagaaccagcgtggtgacgatgatacggaaccgccgctccccggccccggggcggcgtggatgacggctcacgctgtctcctggtcgtgctcgggcgggttggagctggcggcttcgcggtggggagcgtaggcaggtctcagtagtcgaatttcaccgacgttgccgtgttggtcggcgtacaggccacaaccggggcctccggggttgagggcaatcttgaccaggtcagcgaactcttcaggggacgttttagggtccacgcccaggaactcgacacctttctgggcgaggttgatgttgtcgcacagcaacacgatgcgatgctgaatgaggttgcggacggtctcgttggggtaatcggcctcggggtcgtgggagccggtgataagccaggcattggctcggcgggattcgcgcacgtactcgtcaatggcgtgggaggcttccggcgaggacgacatgtgatgaaactcgtcaacaatgaaagcggcgtcgcgggcccggtcgctgaagcacaccaggcgagccagacgggcaatgagcgcgtagagggctcggccaaacaccttgtgcgggggcagctgccgaaacagatgttctgacagcatctcctcggcgttaggaagagcgatgccacaagtgccaatgatgaggatgtcggcactcaggtcggcgggaggaaggtccgggtcaaagatggccgaagctagggaggccgagttctcgatgtcagcgaacacggcaatcctgtcagcgatcgcggtggcctcgggaaggtcgcactcctcggccaggtggcgggccaaacgcccacacgaggtgatctggtggtcacgcatgtaggccggtttgaggaccttggccagcgtggtcccggccacaccgatggtctccaagttaagcaaggtcagcaagaacgactgggcgacctgcccggccatctccgggggaaggatgcgcagcgggtccagcgacagcttggggtgggccgtgtcgacgatctggcgtctaaccccgtcgatagagttgacaaaggttacccactcccgctcatcggagttgtcggtggcaataatgcgcccgccccgggccgcgatggctgcgcacagccgcttctcggccatcgtcttgcccgcgcccatcttgccgatgaacgccaccgtgttgcctttctgatcctgagtgtcggcatgcaaatcgaggtaggccagcgactgcaacggggagcctgtgaccacagccaacgggatgccggtggtacggcccaaccggtactcaaccaccgggatagatgcggcgaacgcggaggcgtgagtcagctgacggtaggcgttaagcgaggaggagaaccggccaccgggccgggcagcccacagcaagtcctcctgacggcccacgggacgcacccacgtgaagtcaccgaacaccggatcattgacgaacgctcctgccagctcctcggtggtctcaaagtcaggagacgagacagtgacggtgataagagcctggatctcgacctcacgctcatcggcggccagctcggcgttgtagtcgacgagcacctgagcggaatgctcgatagacatgagggtcgaagcctgggtcatctcaccgccctcgacgttgtcgagctgatcgaccgtttgacggatagcccgctgatttttctgcatcgcagcgtgacgggtccgggccactccccggatcgccacgtcgaccggcacgccagtgtcgtcgatacggcccaaaaactcgtaggcaggccacgtcatcgtgcggggcaccttacccagcacgatatgggactggtagacggtctcgccggtgtcggcaccgattttgaggacgcgacgattccacgcctgagccgtccgggacatgtgggagactcgcttgtcatcctcgctggccagcaggtcggaggtcgcggcctcatcgatgaccaactcccccagcgcggcacgtccaacctcatccatgagggcgattccctcgccaggggcatcatcacgcaaccgggtcgggtggcctgacaggtgctgccgaagccagatctgttcatcaacggtgaccgggcggggttggaacgctgccggcagtttcgcaccgaattccttagcctgacggagggcccactcccgtgcgacacggccaggagcggtggtcatgagtccggcggcttcggtgattttgttgagggcggcggtccaggcggtgtgggtgcgtattttctggtcttggttgagtttgatcgataggaaccacacgcgccggcctagggattcggtttcaggctggtcgagggtggcgtcgatttcgtcggcccacacggggtgttcgctcaggtcgaggccggcggccatggcgtcgacgatttctgtggggtcggtccaggtgagggctccgttgaggcagaactcgtggcgggcgaggtggcggaataggtcgcggtgagctgcggcgacggtgagggaggcgttctcggtgacgggtcgctggaggggagtgagtcgccaggtggcccagatgtcgccggtggaggtccagacgaggttgtcgaagaggaaccgttcggggatggacatcatgactccttttcggcggcggcgaggaaggcttccaggccgctgcggcgtacagcgttcccggtagggtgcaggggttttctgggggtgggttcagatttcgaatgtgggaggggtttgtggatggtatcggtgtcctcggcgagggcttggtcgagcaggcaggtggccggggtgtcggtagtctcgtccagctcgtcgatcatctcgtcgaggaggttgggggtggtggatgcggcccacacaggtgggatagccggtgcgggtcgaggcggtgtggggaggaggagtttggtttggccccagaggggtgtgtgggtcatgccggcgggagtggtggcggcgtgagtggtcacacgccaccagcccgccagccatgccagaggtgaccaggtccagtcgatgcgaccaacaacgaactgggcgagccatccggcagccagcgcgaaaatgaaaccgcggatggtcatgcccccgtcgataattttgaagcccatcatcgcggcaggaactacgccgccgacagcgagcacctgatagatcgtgtagggcccgccaggaatccttcgacctgaggaatccttaccgataatgcggggctgctggcgggcctcggtgtgccactgaatatccacgatcagctcttgcccaatccttgcatcatctgtccgaagaattggatcgcgttaccttcgataagccagtgcgccataccacacacaaacagcatggagacgatcttggccaggctcataccgtgtttgaagatgttgaacgcggcaatgcccacgactacgaccatggcgacggctcgcaccgcggactgaccttcacctgccttgatcgtcgtccattcgaagaggttctgcgattccagtggcagcaggaggaattgatcgagcatgagaggttttcctttcaggaagccgaccgggatggtcccggtactgacgggctggacggcacgggtgtgccggccaggggcagaaggcgtgacggctggtcgagggaggcaacctcccagcggcctgcacggctgacaagagtcaggccgtactggctggtccgggtagtggattcgtcgccggtgggctggcatgtcacggtcaccgtgacggtaatcttctgccggtctgagggggtggggacctcgtcaggtcccaccacatgagtggttttcactgatacgcatggggctgggtcaaccgcggtgaaagcggtccctgggctgctccatctcgacaggtcagtattcccggtcagcatggcggttaggaagcctgaagaggcttgggcggccgggtcggcggtgcgaagctccgaggtgtctagggtgggggccgaggccggtgcaggcatggggatctgtccaggtagacgcaaggcgatggccttgccgttggaatcgacgtggaccgggactgaccaggcctgtccgctcccggattggccgcccatggtgaccacggtgacctgccacaggctcggatcagacggggagacggtagcgtcataggcggtgacggtggtgggcgctggaccaggtttgcggggcatgcgcgcatcggtgatcttggccgccaccaggtgttccagattgtccaagtgcccggagtcagaggtcagcagaagagtagtcacctcgaccgcggtggctgagacgatctgagctgtgcggcggtcgtgatgggtggtgtcagtgctgacagctgtggtgggagcggatgccggggccgccgaacggaccagggcaacggggccgcatgcgactccgcacagcacgagggcaaggaagcctttggtggccatcgatccggtgtggggccagggacccacgttttcctgtgcctgttttttcttggccgaccaacggcgggacttagggttagcggatgcaccttctggggtgcatgctcgtctcaatcgcatcggtcacctccttcactggatgaagggaccaaggaggtgaccgatgtgcggtcgaacccgaaaaagttcaaacttttttctgggtctgcctcaagtacgacagaaggcctgcatcatcacggcgttgtggtagcagatcttgcgtcagcgcaaatgtatgggcctcgtaggagtagctcttaggtgggtcccggtggttgcggccagggcgagggtgtcgggtatgtgtagcgctagtcccgggttcgtggtgtgagggcttttgggtgctgacatgcactacccattgctagacgctgtgctgtggcatggctggacgtctagcagacgggttgacatcacctttaggctggcagcgcccgaggccgcaggccagaggaagcggacagcctaacgattgacgtccccctctcctttccccaacctcctgga

SEQ ID NO: 195 - DNA, 9465 bp, Propionibacterium acnes
tgtgtgggatcagctgtgccgctcccccgacatggcagacagcaccgttgcatgagaactgactgacactgtggcgccgcggaggtctcccgcggcgtccgctggggcgagtgcatgcctgtcagctcatcttttatcgtcatgtttccccttgtcagagcggtctttgcaaagtgacaacgtcaggggtcttgacgacaacatcctcgacaacatcgtggcggtggtctgtgtctcgtcagttcaacgcaccggggaaagaggcaccgctgatgttcaccaccacaaacaccctcaacgatgagtgggaccagattcgcgccactgagatcgattggcatgactgccctgaactgatgcactgcatcgacgttgatgatgtgttggccgtcattcctgccgcccccgacgccatcttgggctacctcattgcccgggctcagggcggtgacgagttggccacccgcactatcatccaagcgttcacaggcaagcttatcttgatgaccacggccaccaaggtgcgccgtactaatgacggcttcaatgatctgttggcgggtctgtgggagacgatcatcacgtacccgttggatcgtcgccctgacaagatcgctgcgaacctcatcctcgacacgttgcaccgggttacccggttctggcgtgctgattcccccgatgaggaagaggctcacggtctggtgcccttccctgacactctcatcgccccagagcccgatgaggacgtcacagctagccaggccatcgccttggcggtggaccgcaactggattaccgaggacctagcccgcctcatgagccatatttactgtgacggtatgactggagctgatgcgggtcgtctgcatggctgcgctccagctacggtgcgatctcgatgccgtgatggtcgggccgtgttgcagcgcaacgccgagacgatcctggccgtctgctgatccctctcttgctcatgcctgccgccaccctacccctacctgctagaaacatagccatgtctccagcaacgcatctagcgtatcttctagcaattgatctagctatgtatatagctgatgatctagctaccatatagctgtgtctccagcccaaaggacagcccaatggcatgcttgccacaggaaggtgcgtcagcctcccgaaatactggaaggagctttaccgtgcaggacatgacctcgaccagaccgattgaccgatccccgttcgaccgcactattgcggtgtggaaccacaaaggcggcacgttcaagacgtccgtcgtggcgaacctgggatacctgttcgccgccggtggcaacaaggtgctgctggtcgacatggacccccaggccaatctcgacattgacttcggtatacccgcgaaagaacgtgaacggggcatgggattagccgaggcgctacgtgaggggacggcccttcccccaccgcagcatctcagcgaaaaccttcacctggtcagtggcggcgctgctctcaacgagttcaccgaccccgcatccttagcggccatcctcgaccgagtcaccaccgcacgctacgacctgctagctcaggcccttgccccgctggcctgggactatgacctcatcttcatcgactccgggccggcacaaactctgctgtcccagaccatccttggagtagcccgctggctggtagtgcccacccgcaccgataacgcctcaatcactggcctcgtcgacgttcaagacgccatcgacggggttgcctcctgcaaccctgaccttcaactactcggcgttgtcctagccggcgtgggggcccgggccacccggatcgccgcagataaacgccacgccatcgacacagtgctgggggcaggaaccgttttcgatgcggtcatccactactccgagaaggtgtccgtgctcgcacgccagcagggcaagaccgtcgccgagctagccaacgagtaccacaacacccagcccgcctacacctacctagctaaaggccagaacatccccaacgtcgccaaggcagccgtcagcatcgaaactgattatctgaggctggccaccgagatcagcgaccgcatgttcaccagcgacgagcaggagcctgatcatgactgacgatccgactccatccgagcagaacaaccccaccagcgacgacatgcgcttggccgaagaatgggccaacagcggccgcacagtgggagccctgccgcgccgtcaacggcctcagcgacccacaccccgcaccaccagccaaccccctgtctcgtcccctgacacaccggctccgaaaaaaccccagaagacccccaccagccagcctggccgtcaacggatcaacgtcaccgtctacgttgtgcccgaactccatgagcggctgcgctcccgatcggcggcgacgggggtgacggtctcggatctggtggtgcatgcgttagcgttcgtcgccgatcatgcgggggaggcgatcgccgatgatctgcgcgtcgagacgggccccggcatgggggccggactgttcgatgtgaccccatcgcggccagtaggggtcgccaaaacccagctgggggtgcgaatgacccgccacaacaaggatggtttggaccagctgacccggacgagtggagcccgtgaccgcagccatcttgtgtctgtcgccgtgcgcgactatctcgactccaaccctgtaaagaaaggccgacatgtccgctgatgaaactcctgccgcccggggtgggcgacgctttgatacgaccgtcaagcccaggcgccgtcccatgcttatcgccgccggtatcgccatcgtgatagtcggcgcgctcctcatcactcagttgattcgctccgcccaaaccgagcatcgcgtgctggaagtccacgccgatgtggctcgcggcgaggtcatccgtgacaccgatctggtatcggtgactgtcggccaggtcgacaacgtatcaacggttcccgcagaccagctcgactcactggtcggcaaacgcgccacggcagatcttcgagccggatcactcttgcctgctggggctatcggcccggccgatgtcgttccagctccgggcaagtcgctggtcgggctgaagctagccgccggacagatccctatcggagaccttgctgtcgggacgaagctgcgcctgatccagacgtcggcacccagcggctcatccaccaccactgatagcagcaccaataccgatggccagtcgtgggaggcaacaatggcgaccggcaccaaaaagaccgagcaggtcaccttgatcaacgccgaagtgaactcgcgtgatgccgcccggatcgcccaactgacgtcacagggccgtatcgccgtagtgaaggatccgatccgatgagcaccattgttttgaccagcgtctcgggagccccaggggtcaccacgacagcgatcgggctgggcagggtctggccacaatcgagcctggtcgtcgaggatgacacccaccacgccatgctggcgggctacctgcgagcctcccagcacgccgaaccgaacctggccgcagtggcgaacctgacgtcgactccaaccaacgcccaaacggtgtgggaatctatcgccagacccctacccaccgatgacccagtcggcgggctgagacgcaaaggcatcctcggcccgcccacgccgtggtctcgcgcaggcatcgacccccgatggggattcatgctggccctgtggcggcaactggaggaggctggcatcgacaccatcatcgatttgggtcgcctagccacaccactgacctcaacgccacacctgatcgccgcacccatcgtcgaggacgccgacatgatcttggtgatgatcgaggcgacactacgcgacatcgccggcgcccgcacgatggtggagggactcgctgagcagatgaacttggccggcgcctaccgacgtctcggactgcttgtccaccgtggcggccaggcccgcggcgtcgccgagttcaatgacaaggagatcacctcggcgttacgactcccggtcatcggggccattacccacgacccggccggagccgcccaactctccgacggggtcgggcagcggttcgacaagtcacgtctggcccactcactatcaaaggtggcggccagcctcgtcgatgccataaacaagcgccacgctgatgacgaggaggatctgtgatggccagttttgctgataatccgttcgacaagctgcgctcccaggatgcggcaagagcttcggtagagcaggagcctgatgccggattagcgtcggagttgttttcgacgtcgtcggggtgggccagctctcagcaggtgtcccaagctcaaccggtgatgacccgttcggagaacgtggattggccggttgtcgcggagctagccagtacggccactgatgaggttgaggctgagatcagcaggtggagttccactcatgatggggtggcgacgctagacattcgccaggccatcgcggagcctgctattgcctcggcggtgtctacgtatgctgaccgacgccagatcgatgtaggggagacctggcctgatctggtacgccagcgataccgcaaggctgtgtgggatcagctgttcgggatggggcggttgcagccgctgttcgaaatcagcgacgccgaaaacatcatcgtggtgggtaaccatgaggtggttgtcgaccacaacgatggttcccggtcaacgctgccgccggtggccgactcggatgccgagctggaatcccagatcgcccggatggcgaggaatgcgaccccgcggcgagccttcgacgccgatcacaccgatgtgacgatcatgcaccaacagaagttccgtatccacgcgatctcttcggaggtgtcgttgcaaccgtcggtggtcatccgccaacatttgctcacccaaatcagtctgggggacctgtcccagcggggaatgatgccggtggaagtggcccggttcctcgatgaggcggtacaagctggcaagtccatcgtggtcgccggcgagcagggggcaggcaagacgacgtttttacgagcgttgatccacgccattccggcgggagcggttcgccacgttggagaccgatcaggagttgttcgctcatctgatgcctggccgggaaaacacgctggtgctgttcgcccgtgatggtaacggcgaggtggatccggcgactggcacccagcacggcgctatcgagatcgcccagctgattcctcctagcctgcgccaggcgttaactagggtcattgtcggtgaggtgcgcggcaatgaggcttcggccatgttccatgctatgcagtcgggtacaggcactatgagcagtatccactccccgcgagcctctgaggtgccgtcccggctagcccaaatgatttcgatgggcccggtctacgatctggatcaggccatgctgcagatcggtcattcgatcgactacatcgtctttgttcgtaagcgtgacctgcctgatgggagccggctgcgatttgttgagcagatccgttcagtctcgcctggtgattcgacaactcccagtcttggcgaggtgtacacggctgactcgtggacaggccagccgttgaccccgctcatgcctggttcggccgccgacgagctgtctcacttcgcccgagacctggattactgcgaggcccactcatgaacactcccgcactaaccagcgccctcatcgtgaccgggttggggctgatcctggccatcgacgggctggtcccggcgccgcctcgacctggtgccccgctgagcccggcccaaaggtgggccaggctcacccaccgtcccacaggagcggccgggcgccgccgggacctgcgctgggggctggctgttctcgtcggcgtcgtgctgtttgtgctcaccgggtgggtcgctgcgctggcgttgggccccatcatcgtgctgctggcccccaccctgctgggggcggccccaccaaccgacatcccgctgatggaggcgctggatcggtgggtgcgtcaggtcgctgcggtgctgccacaggggcgagacatcatcacagcggtgcggatctcacggccgcgggccccgaagctgatcgccgggtcggtggatcaactggtgtcccggttggatggccgtatggagccgagggaggcgttccagcggatggccgacgagctggactcggctgaggctgacgcggtgctggcctcactagcgttggcggccactcacccgcggggagcctcgacaacgttgaaagctattgctggcaacatccaacagcggttgaaagtgctgcggcaggtggaggctgagcggtctaagccgcgtaactcggtgcgccagatcacactggtcacgatcgccatgttcggggggctgctcgtgatcggacggtcgtttctggccccgctggcgacccctcccggtcaggtgctggtggccgtggcggtggtcatgtatgtcatcgcactagtgcagatgtatcggatggcgcggccccgtcgacgcacccggatcatggtcaggaggacccgatgaccattactgctttgtccctgctggccggggccatcgtcactgtcggactgctggtcatcgtggcagcgttccgcccagccccaggccctgacctggttgccgctctggaggtggtgtcgggtcgcacctcaagcgtcgccgagaacgtcgaccagacccggatcgggcggataggtcgcagcgtgacccgcacattccatgtgtcggtgtccccggccatgcgggccgcactgcgactccaaggcacgacccccgaagcgttctacggtcgacgcctgatctgcgcactgatcggggcgatcctgccgtggctgctcaacgcggtagccatcgcggtaggggcgaattccccgaacctactcatcccttcggcgctgtgtgtggcgttagctggcgctggatggatgctgccggcagcacggttgaaggctgcggccgggcccaccaacgacgactcgttcgaagcgctgctggtattcatcgatttggtcgtgctggaacggctcgccaacgaaacctccgtcgacgcgctcaccaatgcggcaaacatgtcggactcgccgctattcgtccagatccgtcaagtcctcaaccgtgcctccctggaaaacgtcgacccgtggaacgggctagaccggctagccgaggacatcaaactgcccgaactcaccgatgtggtctccatcgcccgcctccaaaacgaaggcgcctccctcgtcgacagtttccgggcccgagtcgccgagttacgcgacgcctacctgctgcgcctgcaacaagaatccaccgccatcacccagcggcttggtttgtggacgatcctgcaagccggctcggtcatgctcatcttgctgggggcggccgccctcacactcatcacagccggataaaccgacaccgtgtcgagcccccatatgggccgcgaacctttcataaagatgcctgtaagcaccacaatattgatcacaacctaacaatgaaggagaaatcatgatgaccgatctcgacctggctaaaaaacagatcacctggctggcggcgcacctgcgttcccggatcgttgacgagcgtggcggtggtagctctaccgtggagacactgatttggattggtgtcatcgtggcgctggtgattggtgtgggcgtcggggtgacggcctatatcaggtcgaagatgcctcactgacgacgatgcgtagcaggttcacaactgatcagcgtggcggtggtagcgcgtcggtggggatgctcctgctgatgcctgcgatcatgctgctggcattcggtgggatcgaggtcgggatgtggtgtcacgcccatcagtcgaccatcgcggcagcccaaagcgccgcggaagctcagcgtgtcgtccatccggtcccggggtcggcacaggaggcagcctcgcagatcactagtcatggcggggtgcgtgatacccggatatcggtcagtgatgacggggccactgtcacggtgaccgtctcaggtcgggccccatcgatgctggggctgcatcttccggctgtgtcgtcgacagcgtcgatgcccaaggagcgcctgtcgtgaggcgaagtgagcgcggcggagcaagtctaagcgtcgaggtgctcatgtgggcgccgatcgcgctggtgatcatcgggtttgttgtgggtatcggccggatgtcgatggcccaggacgcggtgagtggcgcggctggtgctgcggcccgtgcggcgtcgttggagcgtgatggacagtcggctcagtctgcggcgcagcaggcggcgtcggcgaacctgtcgtccggtgggctggcatgtgcgccgagtgtgagcgtggacacgtcagtgtttgcccgtcctgccgggcaggcgggcacggttcacgccacggtcacgtgtgtcacctcgctgggtcttggattcgggtcccggacggtgcacgcaacggggtctgccccggtagacacctatcgggaaaggagaggctgagatggcccgcgatgagcgtggtggcggctcggtgtcggtgtggatgctgctcatggtgccagtaattctggtcatggccggcctggtttttgacgggtcccgtcagatatcggcaacccaggcggcccaggacgcggcggttgcggcatcccgcgccggaactgatgcggcagcgacaccgcagctagctggccacgacggggcggccgtagcagtccaagcggcccgccaggcactatctgctgccggggtggacgggtcggtgcaggaggacgggtcgaccatcacggtgaccacgtctcaaagtcggccgacagtgttcctgtcagcgatcggaatcagccaggtaagggggcatgggcaggcccatgctcagcttgtgggaccgggagaacgcccatgacagtgatacgtcgtatcggtgccctggtggcactgctggtggtgatagccggcttacccgccgggctcgtggccgcaggcgccccgctagtaccctcgggcctgtcatgggcccatgtgcggcatctgttggttaccccagacatgaccgggtcggtgctggtgtggctggtcagcctcatcggctggatcgggtgggcatggttcgccctggccgtcgcagccgaagcggtgacgatgctctcaaggcagcggctgcactggcacatgcccggccctcgcctagtgcgccgagtggcagccggtctcctcattgccgcgttcgcggccgcaccggcagccacaagcacggctcacgccgccgagaccacccatgtggcggtcgccgcccaggctggaccggcacacgcggccggcacccaggacagccccgccaccacctctcaggccccggacgcctccaccactccgaaaatctggaagacctacacggtgcgggccaacgactacctgtggaagatcgccgagcactactacggt

SEQ ID NO: 196 - DNA, 3127 bp, Propionibacterium acnes
ttggtattggtaggcgatggtgtcaccggttttgttgcggatgacgtcgaagccttcgatgtcggaggggatgtcgtcggcgtcgtagacgacggtggtggtgacggggttggaggccgacatttggccgatggtcacgcgcagcatgtttttcaacgcggaggtgaggattgtcgtggcggtggggtttttgtctgcccagcgtttctcggcgatgtcgatcatgtcttggatggttttgacccatcctcggatgggatcgactttggtcagtttgatcccttcgaggaactcgatgggctgggtgatgggcccatcaggaccgaattcagtgtcccagccttcgtcgatggctagtttcagttcggcggcgtcaacccatgtttcgtgggtggtgccgggcacgttgggccaaaaccatcctgctcgtcctttggtgcgtttgaccggtagtaggccgatgtcgtcccaccaggatggcacggtgaagcggatgtggtagcgggccgggtgccaggggttgttggtgaacaggtcgcgggcttcggtggcgctgagcagagtggcgggtgcggcaccgatctctccggtcactgatccggcatacatgaatcggccgtcgatgtacacgaagttagggatagggccggcaggcacggtggggcgccaaccttgttcgcggtcctcggggttgccgtcgtcgacgcatagttcgtagcggtgctgaggggaggtgtgttggatgagtgcgcccagttcggggtccatcggctccatgcgataggactcgggggtccgtagcttccagaggttgattccttctgctccggggcggtccatgagggcccagtcgcggtcgattctggtggcgatgatgtgggttaattcgcgccatgcccagcgggcctggattggggtgagggtctggccagggaaccattcatcagcgaccagaatgtcgaggttgcggtcggtttctttgtgggtgaaccggcctcgggcgggccgcccggacagcatgaacaggccccgcacgtgccagtcctggttgaactcgcgggtgtgagcgggggtgtcaggcagcagccaggattgaggctggtcggggatgttaccgcagacgatcaggcgtcgggcgttgtggtgtagcgcggttgttagcaggtctgacagggtcgcgtgcttggtgcgccgcccccctagcactggcaggatctcgtttccggccgcgtcgactccccgggcggtgtcgatgtctagccacactgtttcggggtcggggggccgatgtggggcgggacggcgctgctcctggtcgtctctcatggtttcctcctttgggccagggagcggccggcgtcgagggcgttcatgcgctcgcgttgttcttcgcgtagttggtagacccggcctcgtgacactcctgctgcctcggcgatggtggtggccggcaggtggccgatggcggcagcgtcggcaaggacgtcacgccaggccaggtcaatggttcccagctgggctagagcttcgtcgcggcggcgggtggcatcagccactacggaggcccaccctgtggggtggatggtcttgacgacgattcggttgtggcggatggggccccatgcatcagcggggacttgccagccgtgattggcggcggactcggtgatcttgaggcgtcgctcaggtgcgcgggtgcgggcagtgacgtcggtgttccaggtctggactggtacccacgtcccctctcggatgcgttcgatgacgcacgtggtgacctcgtcggtgactgtgatgaccagacgataatctttcccgtctggggtggttcggtagctgggcatgtcaccctcccctatctgtcaaatgagctagacacagtgtctatttaatttgacgcaaagtcaagtgcgctagacgcctttgtgtggatccgcccgcccagacaggcactcacgtctcatgacccgccgcgacgtcttaacgaaaccaaaccgcttatagaaccgctccgcagcgctccccgagggctttagctccaaggtaagaccttgctggtcggcccattggcagacttgggtgaggatgtgtgatccgtagccctgatttcggggggcggcatgcacgcacatcagcatgtgaccatgacggcgggtcggcgggctgacataagccccaccacgccagtccggtgtgatctgccaacttcgccatgccgcagcgcgccagcggcgggcctcggtagccaccatgatcaccatgatgatggacagggttacgacgccgactatggtcagctcactccagccaggccagttcccgcagatgatccagcctcccagcgcccagatgatcatggcttccacgcccgccgcaatcgggacgagtggggcagtacggatgcggcctgccatgatctcggtgatctcgctgcgatgccatgacaaggagaattcccacgactcttgaatcatgctgatgtgtgaacggcttcctcggcttcgctttgccatagcttctctagacggcgctcggctagctcgtcggggcacggcgacagcctgccgcactcggagcagaccccgaagtggcgcgagagagtgatgaccggctcatcgggagcatgaaccgactcaacgaccgggtgctgctcatcggtgagtcccgaagcgtgaccaatctcggctagacggaggtgaaccataccgtcgtagtagtcgaggccttcaacgtggaacgggtaggagccgtccgcggtgtggcctgcaaccaggtccccgacttccagctgactggcggtcatggttcgcaccggcggcagcggggtccgggtcgcgttgatcctcatggtctctccttgcttctgcgccttcatagatgaaggtgccacagccggggttgatgtgcggaaccacagccactttttcagcagatccatcaccacggtctcaccccttcccaaatgtgtaaaccatgatttacacatttggggcatgatcgaacccacaaccatctccaccacgccccgcgtggccatcatctcccccagcgggccaccacggttcttggccgagcctcccagcatcgcactgcgccgacacggccggtcccccatgaggtcccttcc

SEQ ID NO: 197 - DNA, 1732 bp, Propionibacterium acnes
tcgctgactacctgcccgcctgatcccaccccaatccactcgggcgcctgtcagtgccccctcttctgggtggtggtccggggcgtcaccgccccggaccagttgggtagtcatctcagttgaaataagcgattagtgatacgcccctcctgctttccggtgctgtcatgagcgtctgacaacagcgacacctcggggcagccgacggacagtcctctggctgccgctctgatcccatgcccacggcacgaaggtgtcggacagctcggtctcgtcatgtgcccaaatagcgtcgtgggcctgtcgccaagcttctcgggagccccacacgggcacgaccgggccacaccggtgtcctggtctccagtgtcgcgacactgtcgatttcggtacgtgcaatgcggcggcggtttgacggatcgacatcccagactcccgcgcgtcccagatcgccatgtggagagtatttgcctccagtgcggccgccacacttgcacgctctcgcgcacgctcgaatgcccgcctagtgctctcaaatgtcgtcacgacgcctccccctgaaaatactcagggtgtcccacggtgggacaccctgagtatttcataccccaactcgcctcaccacacgtcgacctcgacaccgatcaagcgacccgtatcagcgacattgccgtaccgctgacccgcctggtcctctagccacgacaacgcatcccgaaacagcccgacgtcttccaaagctaaaccacagtcgtagccgcccttgtcccccaaccgcacaatctggcgctcccggtggcctccctcgtcgacctcgatccacagtttcgcgtgcatccgctggcctcggccctctgacaggatctcggtgagcaggtcggacgcctgccctcgcgcatcctcgttactgcgggggaattggagtatgtgggaggaacgacgatgggggaggttggtgacctcgtgacgcagcaggttgcgcttgtgcatctgctgatcgagacgctcgggctgacctgttgacggggttgagccgtggcgccgcttcctcggcggggtctcgatccgttgctcttccggcggttcggcgtcaggttgtggtgcgcgatctcccctaggacgggggggctcgccacctatatccgagggacgatgagacggccttccacgcttgctgcgcactttcgcagcccgccccttgcggtcacatcgacgcggcggcggggtaacctcctcgccccgctccaactgtgttaacgcctcgaccaggttggtgccaggcttaagcccttttagcacgaaccgcaccaggcgggggtctcggccgattcgtcgggcaatctcggcttggctccacccttcggctaacagggtgcgcaccaggtcctgagcccgattgtcacgctcagtcactggtcgcctcctcggggagtcctacttgctcggcctgctctgatagagcagcccgttccgatccggtctggggcgctttcaggggaccgggtaggacacctttgacacgcagtcgcccgtccttgccgtcgtcgccgcccccctgggccacagggagcgcccaggggggcacgttgctggtgtagatggcgtcgccgtggatagccagcagggtgcgggagttcatgcgtagtgctcctcccttggttgtggcgttttttccggtggtggggtcggcgatgggtgtgttgagggtgcgtacgcgggacagggcccagat

SEQ ID NO: 198 - DNA, 718 bp, Propionibacterium acnes
ccggggccctgctgccggtgtgggacaccgccgttttgactgggcctgccctcggcagacgtgtgcgccctctcagcagtgacgccgaactgacctctcggcggtggctcgaccaggtcgccgaccatcccggcttcctcgacacccttatcgaggccgcccgcatcaccgagggatggcatcacgcaacacctccgcacattcaggccccttaccggacccttcatcagtgaacggaggtacaacgacatgaccagcgacattgacattgaccggacccacaaacccgacgaccgcgccgaggctcctctttaccggtcctgggccaggagactcgtgcacgtctccgggatgccctggcgtatcgtcgccgccttggccggggtctcccccacctccatgcaccggcttctattcggccgcaacggtcgacccgtggaatggatcggcatcaatgatgctcgcgccctgatggatatcggcatcgatgatctcgcctcagcgtccaccgaccgtatcccggcccgcgaatcccgcgagctgttggtagccctgcacaccctcggctggaccaacgcgcacttgagccgctggctgaccagctccgacctcgacctgaccaccacccccaaagccctctacgtcacccggctatccgccgcccgcatccaggccacctacgacatgctcatcagccaacccgtccgccgctgcggcc

SEQ ID NO: 199 - DNA, 12176 bp, Propionibacterium acnes
aaccgtcatctggcgtggagtagcgagctgatgcaggaaggcaatttgtacggccttcccgaggaagacccgttgtggggcgaggccgtggagctggtagcgggacttatcccctctgtgcgggcgatgtggtcgcacgatgggcagaccgtgactgtgtcggctggccggcgggtggcgacactggggatgccgatgcggggatggcgtggtatcgagatgcgcggctggaatccagtgggcgccgatacgtggtggatcgttgaccaggtgggtagttggctggtcgatcaggatgagccgatggtcgttgacgggagggtgctccatgaggcgtgggaacggtcgcagatggtccgttcaggccgctgagaaaaaatttaggtccgccctgcatatctccgccctgcatatcggggcctcttcataccttcaaaagtgtgaagggaatacagactcttcgactggaattaaaatggtatatggcgtgtccggtccgcacccagctccacgatgcgccataggggagccataacttcaccaatcgtatacgatatgagtgtaggtgagcatctaccggtggccgacagtcagatacaagcatgggcggatgaagcagaagctgattatgacctcagcatgcttccgccgtctcgacgtggtcgcccaccggtggggaggggcccgggcactgtggtccctgtgcgcttcgacgcggacactctcaaggcgttgtcacaacgagcccctgacgaaggattgaccacgcgttctgacgcgatccgtgctgcggttaaccagtggctcggcctcggctcgtaaacattatcggcgcgacaaccttactgatgacgctgttggttacgccgtagagcacatcttgtactcgtgggcgctcgacgatgctgatgatcctcgttgctggatgatgattcggtgttgacccagctggcctcctcatggagctagttatcctcatctacgacgatggctatgaactcctgatccacgccatgaaagcccgccctcagtatctgagctacttcgctatctagtgttgttgggcgagttgaactcaacttttctccgacgcaagcgccaataaaaggctgatccatccgaataccaccaaacacggctgacgtgtggaacagattcagcaagacagggtgcggtgctcgggtgcgttggggagatgaggatattcaggcttctggcgggatgtggcttgatgacgtccaggatcaccggttcggttttgaaggtgccttgcattaatgtcgacagggtcgtacgactcgaggattggatcgaccagcccgttgcgtctgaagaacttcatccaccccggtggagctccggccgcgtactggtgcaacggatcattagcatgggtagcgtgagtatgccttcgatcgtggtcagtgctgtcatcatccaagattctgacgggcggcttctcactgtccgtaaacgaggcaccgaggcattcatgctgccaggcggcaagccggagcccggcgaggactcgcgtcaggcagtagtccgggaagtgcacgaagagctcggcgtcgcattgtcttccgacgacctgcgtcgggtgggagtgttcaccacgcgagcagcgaatgaggccggccatcaggtggtggcgacgattttcacccacaccccggttgcggtgagtgagccagctgctgagatcgagcagattcgttggctcgattggagtgtcgacgccctgcctgacgacctggccccgctgctggtcgaggcagtcatcccgtggctgcggcgccgtatccggtcggtcgctgtattcacgggtgcgaaggatggaaccgaccctcattatcgtgtcgaagcaaccgccttgggccggggtctcgcacacgccgggatcaccctggtttatggcggcgggaaggtcgggatgatgggtgctgttgctgatgcggccctcgctgctggcggcgctgtgatcggagtgatgccgcagcacttggtggacggggagatcgcccatcctagtctgactcacctcgaggtagtgcggactatgcatgagcgcaagcagcggatgagtgacctagctgacgcgttcgtcgcgctacccggcggcggcggaacccttgacgagctattcgaagcatggacatggcagcagctcggtgtacacagcaaacccgtggccttgtacgactcgaccttctgggcaccgctgaccgcgctactcaaccacatgaccatcgaaggcttcatccgccctgaggaccgcgcctcgctcgtgatcgccgataccatacatcagctgatggccgatcttgagggatggaccccaccaccaccgaagtggcgctcgtgacatagaacaaatgattctgactatggctcattgacatctgcgcagcggctactagctccattgacttcaaatcgggccttggccgaggctcggttcaggtggcccggaatggatccccacaaattgaatgctcatgatcgaggtgatgaacgcccactctattgtcctacgcccggttgtatccagcgagcaattgaaggtgctgcgcctgttggtcgaccaggccgagccactcatcatcgacgggcgcatcttgtacgaggcatgggacaggctgcaaacagcccgtccggcccgctagaaaaaatttttagggcccgctccgcacatcccggtctgtacccacaccttcaagggtgtgaagggaataaaaacacacctaacaacaactttgtttcatgatttggcgcgtcggaccctttctgaccgatgtcgtgcgcaacaatggacccatgagttcgcctaccaagatgcgccggaaggggacacgcggcccgaaacctcgcagcgacgaggagctaacggctgtgatgttccgcgtcccagagtcagtggccgaacgtgtcagcgatatggcttgggagctgaggctctcccgatccgatcttgtgggctggtcggccctctatgcactcaactcgatgctcagacagcgcggagaggacacgattccggttccggagtatctggacaaggccgtgctcgctgcgttgtatcccgatgggttgcccttcgacgaggacaacgaggagccgggcgagaatgccgggcaggaggagcttgcgatgactggatgagcccgaacatggttgaaggccgccccgccaggcgaccttcaatcaatggtttcggttgtcagctgcagccacccttgccaggtgctgtggttcttctccagaggaggagggaccgccatgaagaccaagaagacctagaagatccaaaagaaccggtttcggctgttgcttcggtcttcatggtagctgatagcccgcgtcgttggaagtgcgacgacgccgatcctcatcggtatcgcaccctgttccagggtcgagaatgtgaaggattaacaaccatgacaagtcatgaggcgtcctcccggagggcgtcatgaccgctttaattcaagctctgccgacagctgaactgtctgctggacctggtgctagcagtccagctagaccctctgctgagggcttcatcaagattcatcacgaccttattagtgcgggcgtgtcgggtaacgcgatggcgttgttcgtcgcgttacgtaaccagcccggctgtgatcagtggacccgtcactcgtacctgcggctagcccaatggtgcggctgggatgggctgtcgggggcggcgggctgtaagcgggtgcagcgggccgctgctgagctcgctagcggtggttggctggaatcgcgggtcggccatgatcgtcgcaccgctaagacgctggtgtggcatcggttgaccagccccgacaccgaccgctgggagcaattgccgcggattgtgtgggcgaggatctgccagatcgccggggagacgtcgggagagtgggtgaggcattggctggtgtggcggatgctggccggtcgtactggtgtggctcaggcccctatgtccatcgtggctcggttcctgggctgttcttcgcgccaggtctctcatatccgtggggctctcgttgatgccggtctgctcggctgtgacgaggtgtcgggggcggcgagccgggtgtggttcccctcgatggccgaggagtgtgcagcggatcgtgaggtggttgatggggccgtcgtcggtgctggggtgggctctggtgaaggtgtcgaggagggcggggaacccctgtcgattttgtccacccacccctgtcgattttgtccacccacccctgtcgattttgtccgccaagtattagacaaaccattagacagtgaattagaccttgggtcgcgtcagcgtgttagctcaccaacgcgcgcgcgcgcggcggccgagccgccgaagccaaagaaacccataccaccaacgcctgaaccagcagcccccgcttcagacagtcctgtgtcagcgcacgctgatgaggctgccgagttggcgtggcggttcgtggggtggtgtcctcagctggtaggggcaccgaagaaggtgcgtggccagctccgtcagctggtcgctgccgagatccgccggaatccgggctggctggatgcgccagcgttggaggttgttgcccagcgggtacgtgctgaaggtgcgctgggggtccagcactgcgagattgtgcgagccgagctgcacggggtgatcgccgaccagaaggccgcccccgcccgccccgacgccctgcacgcgcgggagcccaagtggtgggacgacgtgtactacgaaggaaacacaaccgtgtggtacgactctgacgaaaccagtgacgacgacgaggcgtggaaccggtcgcaggtatgtcatgttgctgagcgtgacgacatggctggcgggattgctaccaacctgctggcctcccacgctgatgatccgatggcctggctgactcgccgtcaaaccatgctgatggctcgtttcccccacgcccagaacgaggtcatcgcgatgtgccacatcgtgcgcaccgccctggaggccgacatggccgccggaacccggtgggaggactgatgagggtctcccggcgcgccctcatggccgtggcccgtgccgacgctgccgcagcagaccatgccaccggccgatgggtggccacagccaacgccaccgtcgcccggctgaccggactgtgcgaacgcaccgtccaatacgcccgcgccaccctggtccacctgggcctgtgccgcgtcgtggccaccggccgctacctcaccgccgacgagcggcgcatggctgctcgcacccatggcggccgccagatgcgcgccgcctccacccgcgtcctcaccatgtcctgcgcaatcgtttgcgccctaccccgaaggggtcaccactacaggaaagttaagttcctagatggtcaccaacgcacgcgcaggcgcgtgcgaaggccagcaacaccagagaagaaacccctgtggctgcaaaaactcgcagccctcctcgaccagcacctgccctggctggtgagaaaccatcacatcggccgactgtgccacgccctcaccgccctgggcatcgacgaacactggcaacccgcagacctcgacgccctcctcgacgccatgaaccgcaggaaccgtcgcctcggcctcgacgtgccatgcgccgacgaccagcacaaccccttgggactgttcatccaccaggcccgagacaccctcacccacgacaacccccatgaacgccgcctggcccgcgaacaccaccgcgcccaactcatcgacgaccaactccgccgccgcgcagaaaccgccacctgcgcagcccgcctcgcagccgagcacgccgaccccgactaccagacccgccgtcgtgaacgcagggaaaccctgcgagccacactcagggccgcccagcagcatgtcaggacacactgatacccgctcatacacacaccgtgaaacacgacaagccacctgacagtatcagctgcaagacgcatgacaacatagaagggcatgatgaaatacacatagacacaaccccgcacagcagtttcgcaacaaatcatgatagtctcatggcagtatcgcttgatacacacatagcatcactcccacataggcagttatgctgatatactcctactaggttatccgtccaacatgctgagtgggttcctgtacagcatgaaaggagcatggcatgatatgggccgttctcaactgcaagggtggtgtcggcaagacgaccagtgccctcctgcttggcggcagccgccgccaagcagggccacaccaccctggtggccgacgctgacccccagggcaccgcatcccagtggtcagccctggcaaccaaaaacgacgaacccctgcccttcccggtgcaagcggtcaacatcgccaccatggaggcactgcccaccaccaccgacgcccatgatctcatcctcgttgacacacccccctcggcaggcgatctgatgttccaggcatgccgcatcgccgacctcatcatcatccccaccgccacctccggacccgacatctcccgaacatgggtcaccatggacgccacacaaggcacaccacgcgcgatcctcctcacccaaaccgaacacaaccgtgtcgtctaccgccaagctcgcactgccctcgccgccgacgacaccgtcgttctcctggaccacgacatcccccgccgtgaatccatccgcacagcatggggcaccaaccccccagacgacgtcatcacctactacctgcccgtcctcaacgaactcatggaggccctgtcatgaccaccaagaaaaccgacccattcgcccgccagaaagcagcagaagaccgcgcccaccaactccaagacgaagcccaacgccacgcccaccccaaacgcgtcatcggccccaccgcacgattccagttcgtcctgccagccgacgtgctcaccggcctcaaacacctcgccctcacccgcggcaccaccgcccgccaactcaccctcgacgccctcgacaccgcctacggcctcgacaccctcgccaacagcgggaagaaaacccacccatgacccgtgggtccccctgccaccaccccctcgacggcaactgtgtgcgagccacaggcccgcacacaggcggcagcccagtgccgtccccgccaggaaaggaactgaacttttctggagtgctggctccctatcaccccttatggtgctatcagatccagtagcgccagcccgagaggaaacccatgagctacatcgtccgcaccggaaatctagccggcacccccgagctgcgcgaggggtagccgacacggcggaccgtgcccctgacagtaagcggcactactggagacatcaccatgaccgctcagatcctcgccccgtgcaaccagaaggctgccgtcatcgaaggagccctgccatgaaccaacctaccccccacaaggccgacgagttacagacgagcaacaccacgaggaagtggcggcacaaggtgtcgttctaccaagacccggccgacaccgaccgagtccgcggagcgatcctccacaccatgacaaccgaaggcaaccggaacctgagccagttcgtcaacgatgccgtcatggccaaggtgaccgaactggaagcaaaatacaaccacggcgagccattccccgccgtgggagcccgaggactcccccagggcggcgcagccgccaacagataagagggcggggaccaccaatagcagtcgatttcggatccagatcgggtagacaggacccatgatgaatttcatatcctccctgctctcggccatcctgaccctctttgcgatggtagccgtggcgataggagtggtgaacattgtgccgggaatatgcgccatcatcggtgcacggaaatacggcgaccaggaccgtgtgcgggcaggacaacgaaagatccttcttggtgctatcgccttggtggtagcagtaggcattcacccgtgacccacggttaccggaagccccgccgcaatcgataccactgtcagtaccatcaggggcgataggggtcaagctctccttgtcacaatcccttccccggcagcccagtaaccgtcgcttacagccatacatggatatgcgcccattcgtcggcaccgacgccgtgcgggttggcgacgctgacccgtctgctcacaaacgacccttccagcccagcaccacccactacaccgacacgatccacgaagctgaaaccgaacctcccatccccgtccgaaacatcaacgaactcatcaaccccaccaaccatgcatgaacgcacgatcgcctaccggccagccttcctgcgcgacgtgaagcggctcaaaaacaagcactacaacatgaacacacactcaaatgggcggtaaggtcacgaagtcgacgtggctgcctcacggatggcttcggcgagctcttggggtcgactccacatgggccagtggccggttggcagatccatcgcggtgaagttggtcaggtgcgcgacggcgctgaacatcggattgcctgctgcggccagctcgaggacctggacgctgggaatggagcagcagatcaacgtggttagtacatcatggcgagcgctattggacagcgcgacccgtgcccgggccacttgcgcgggttcaggaaccgcccgtgcccggaaccggtcaaggtgctcgttgctgaggccctctaaactggcctgcttgccgagagtatcgaagtcaggaagtggcagctcagctgtttcctcaggtagatctggtgcgaaggcacctccatcgctcatgggaccggagtccacccagacgatccgatggaccaactctgggtgcctgtctacaactaggctcaccggcccgttcgcgccactgtgtcccaccaggaccgcatcgccgcccatctcgtccaggatggctgagatggcgtcagcttggtcgtcgagcgtgcgcgtagtgcgctgggtgtcctccggatcgaggccaggcagcgtcagccccacggctcgactgccagcagtgttcaataactcgactacctcgtcccaagcccaggctccgagccagtaaccaggaacgaggacgataggccgatgctggtcaggtcgcgatgttgaagtcatggagacatagttgcacagtgcgcggacaagggagtggcactatttctggcatgaatttagatctgggtgtccggtgaggcgatcagaacgcctccatgtactgtccgagtgtctacgatgcagcggacacagtcgagcagctggctcacaagtttccaggtgtccttctgcccctatgagggaagtcggctgctctcgcaacctttgagggctgctctggggtcggaaccagttacagatcgttcaagttccgggaactaccgccggtcacgctgattgattcccgggcgatctcgcttctgacgacagtggtcggtaaccgagaggcgtcctactctgaccccgctgctgcggtgagtaaatcacgggcgtcccggatccggccacccgtccaagtgccagccagcttgatcggctaggcatcgtcaaggagcgacgatgaggtgatgatgcgatgtgagcgcaccgcgaagtgaggtataaagaagccttcccgggcgcatgcgtcgcccaggaaggccaggttggcccctggacggctgaatggttgggcggatcaggctgtagcggagacgtgcagtacctcgtaggcgatggcgttggttgggctctggtctgcatcgtggctactgagttcgacgaggatgacggtccaggtggtgatgtcgacggcggtgacgcgggcgatggtggaatcagtggatgctgcaaggaagtcggcggttatgtcttcgatgcagtgggacggagcagtgctggtgggcaggggcacggtcttgacggtcaggcttcgggcagcagagtaatcggcggttccgttaacaagctggtggacggtccagtcctggatcgggtgccggccgaagtcgcgtacgatagccgagtaaccaagttcgccccagcagaactggcgcatcccctctatgtcgcgccagacgtagaagggcgcgtaggagttctggggtgcgcctttgaccttttcttggatgaggtaggccttgaactccagtccatggtagccgtccatgaggtgtccagtctggatgacgcggtcgcggatgatctgcatgtcatagtcggtgggcagggtgatctgatattgcatggcgtacatcagcggttctccttggtttcgtgggagtaggtcgtgggggtgacgggttcctgccaatcgatggttgacaagtcgttggcggcttgttggtaggtaaggtggatcattggctgtttgagtgcagcgccatgccagtgtctctggccggcgtcgatccagatggattcgcccttggtcaggtgctggggtgcttgtccttcaatatggaccagggcaacgccgcccgtgacgtagaggccctgtcccttggggtgtgtgcctcagcggcaaacgtgacggcgtgggcggcacgcccggcgtcttccgtggcacgatcggccggatccatggcggcgcgcagctgctgttctgcagccaggcgtccaggtcacggcgggcagcatcgacacccagggcagcctcgacggcttcagggctacgacgctggccgggctggttgaccgcagaccactggtgccgggcgtcgtccagatcatggccggcggcgtcgatgagggcggtggtggcttcggcgcagcatcgcctgatccactccgaacgtgacaggccagctgtctcggcggcactgtcatgcgcgccaggagagatttcatgggcgctcatctgtagcctccagataggcgttgatgtagcgcagagcctgatccgtcatgtcgatggcggctgcctcggcagacgacacaacgggctgtggatgataagaccacccaacatagacggcgaacatcaatttctcgacagctttcatgaggtccccggcggcaaccgcatccgcctcatcatccgaggagaaccacttcaggtctgaacggctgtacatagcccctaggtcctgatgtgggtcgaggtccttggaatgatggaagttcctacacacccatcgccaaagacctcaacatggacaacgctaccttcaccactccctcatccgtgaagagccagtttatgcacggtgttgaaagaggcgtcggtctacgacgaatgcgggttaatggtcttgcggtgtggggcgctgggcgatggcatcgagaacgcgtgagtgggtggcgatccattcggccgcgtcggggttgatgttgcgggcgacggtgtcgatcgctgttacgtagtgggcaagcctgcgaatctcagcttgttggtcagggtgagcgctgatgaggggctcttgatgggaggcgcggttacggacgtggcggatgagctccacgttttcctcgaagtcgcgtcggctacgccccgggtagtgaggcatacctccgttacgtaagtcagtgagagctttccatacggttgcttccaggcgcggggtgagcagaaagcgccagttgtccagtgacagactcgccacgatctgatcaggggtcgcatcgagcctcgcgcgccgcagtcgcttctcggccctgtcgacgttacgcgggaaaccaccgagccgatagctcggggattcccaccaacgccgtatgccagtatcggcgctcaggcgcacgtcaatgaagtttctcaggagtacctcgacatggctgatgtcttccaagaacgctttcgagatgcgggtgttccacacgtaccacgcatcgactggttcgatccggtagcggctgagcctggcgggtgagaaccactcctgcaacgtctcacgactcaccgtgggagcgtggtaagattgatgacgataggcctcgggaaggtcaatgccgcgaaatatcggtatacccccgaggtcattgtcttgcccaggcccctcctcgcatacttgcggggcgtcattggctgccgtcatctcgtctcttcccggtacgtggctgtccatgttcacgggcaggtacggcaatgaggttcccgcacacaaacctctaccaagcatacgctggcaagccgttgcatgagacgacgcctccgcccgccacaccaacggtcaccgccacggccacggtgaccgtgaccgtg

SEQ ID NO: 200 - DNA, 7612 bp, Propionibacterium acnes
ggttggactctgcacccatttcagccgggtacgttgccggctgggcgaaggaagcagacggcgccgcgattgaagctgccgccgagcacgtcgcgaagacctcccacgcgattgccgaggcgttgcagctcaccgcacagtgagccccacggggcgaccggctcaccccggtcgcccctcaccccccgacaggggaaccgttcccgccgcctgaatctccatacccctgatacgtactacgcggggtcgaggagtggactccccccgccctcgtgtagtacactgtactacagatgtcttaagaataatcccgaggtgacgtcatgagtttttcgatccgtttaaccgaccatgagcgccgcttagctgattcctacgcccgcctgcactcgcagtccctgagtgaggctttcaagcaagccctcttcgaccgcatcgccgacgagttcgatctgcaagtagcccgtgaggcactcaccgactacgcccgcgacaactaccagtctcgccccatcagcgagctatgggacgagtgtgacctatgagctggcagatcgaaaccacgagccggttcgataaagaattcaaaaagctagaccgctacacccaaaaactcattcacggctggatcacgaaaaacatcgacaacaccgacgatccccgccgccacggcaagcccctcaccggtgatctttccggactgtggcgctaccgcatcggcgactaccgcctcatatgcacactcaacgataaccgcctcaccatcctcgccctgtccatcggtcaccgccgcgacatctaccgataagccgttgcaagactgcggcgtcgacaccgccgggaccctggcccaggccttgggcctggaggaggacgagagcgaggagcacgccgcctgagcggtcgccggcacttcccataacagcaccggtcccggcggcccggccccgcgtctggtgctcggaccgatgccggcgcctggcctccgacgcccgccggggccagcggctgggctacctcgacgtcgacgtacaacgggccgaacgaaccgtgcgctgatttaccaccgcttttgcgctgatttaccaccgcttccgcacagagaacatgcctctgactaggagaaatgacgttttccacagggcctctattactaatatccctattatctctatccacgcgcgcgagcctcagcgttcaagcttcaggtcttgctcgtctccctcgcgcctcgctgcgctcgttgctactgccgccccacccggcaagccgggtgggttgccatcggaataccgtggaccatcccggcgcatacacccagacggtccaagatccaatccacgctcacccgcgacgccgctaacgatcctcatacaccgtagatgccgttctgagagccttccagacccgcacgtgggtttattgcaccgagacccaaatcccctcagaagcgatcctgaaaccgtctacgccccatttccgacggacgctggacaggctgggcggcttgtctcccgccgcagacatggccctggcatatgcggttgccgactggtgggatcagggattggatcacacggcagacggctggtccaaggcgggtgtgcaggtgcggtgagcggcagacgtgaccggtggggtgcactgtcatggccgggcatctgccgagccaccatgcgggccctggaccaggaggcagcccgctgcgaggactgggggaagacggcggcacggatgggccgtcgggatgcggcggccgaattcaccgagactgcggtgcagcatcgtggacagatgcaccacctcatgtcggcacaaaaagtgtgggtgtcgaccgacatggtgtcggctacactggacgccgcaggagacgtgccgagtttcgaggccgtcgacgtccctgccgccgggctcatgggtttggccagccccctgccgccggttaccctgcagcatccgctgtatctgcgcagcgacgagggtgtgacaaccttcactgatccggttctcgtcgacgcgctgggatggtggatggattctgggcgtgtgcacgtggtgatgtgcacacgcataccccggctgcccaacccggtttatgcggtggcctccccactgacggtggtggagaaaatcacggtgcccaccggcatcgagttcgagaccatggagtccaggatcctgacccccggcggcgtgacaggcgtctcacggcagggcacacgcatgatgatccggttggcgtcatggctgggtgccgcgtgggtgctcatggcgactccgacggtgtcggagccgcaccctatggatggccggtggggaggcccagcaacggggcagacccggccgcgtgatcgggtgaccgtggtcgacatgcggcccatgaggcaggtgcacaccaccaccgaccccactggcaggcggttgacgacccggcatgtcgtgcgaggacactggacacaccaaccctacggcccggcccgcagtctccgacgcctgcagtgggtcgccccattcatccgcggccccgaaggggctccgttcgtcggcaccgacaccgtcaccgtatggcgccgctagatacgcgggcgcggggggttgacgaacgatgcccccctctttgtgttgtgatcagtcgtgatcggcgggttttaggtcggggtaggtgtcgagaatggccttgaggacgaggtcttggattgtggtgtcattctgggctgccttgaccttcagtccaacgccgatgtcccgggggattctggtctgcaacttgaacaggtctgcctccttggttttgaacagtttggctgcagggttggcaacgggctgttcttggcgctggcgtccaaggttgcttttctttcgggcggtcatgacatcatctccaacagttcgtcggcaacatcggcgaagaaggcgatagtttccggctcaggggtacagccgtaggcgcgcttgatgacttgacgcttggggatgacgtgatcgaccaactgcgtctgggagtcgttggctagaaggtcgcgaccttccttgaacagggaggtattcggttcagctttggaaagcagcaccacgcgcggggttcctgcggcggcgtcgtgcgtctcccaggtgcgcgccatgtcgagcccggacgtgtcggtggggatgataaccagatcggcggcgcgaatggcggcggtgatgatgtcaccgttgcccggcggggtgtcaatgatgacaacttcttcgggtccggcgacgaggtgctggagcgtcgccttgttggccggttccacggggaaccccaaggggtcggcgttactcagtgtgcactcggcccaggatgatgctgacccttgagggtcggcatctttgacgcggaccatacggcccgtctcatggagagctgcagccagcaggatcgctgccgtggtcttaccgacgccacccttggcgttgataatgctccagatcatggtgacacctttcagtgaggatgcatatcagtttacctgcaaggagtaaagacggcaagcagttatgccgtttctgcggcaagccgtcttgcatccttggatgtatagatagttgtctacttatggttgtggatcgtggtgtctcgtaccaggatttagtgtgctcgctgatatgcacgactttcgggcggcctgatctggcggtggtgccactaacccaggagtctgatccgcaaggtgtcctcgactttgaggaaggggtctctgctttcgtgttgacctaaagtcaacggccctgggcgatcactgaatcctaataactttgtatccttccctgattgcatcttagcatccttgaattcaaacagggatggagccatgctgttttgacgacatggatgcactggggtttggttgttgccgatgcggagcgtcaggcggcccgggacgccgccaccgccgacacgctgcgggagatcgtgggactgctgggccggggcggcgaggtcccgcccgccaagacggggcgtaagacgaccggcaggccggccccggcccgcaagtcgtcggccacgcagtaaaggcagggatccgtccctacgcagagagcggaggcagatcctgggggatccgactcttcggttccgtgatcttcccggagatcttcccggatcccccagggctcatcctgatacggggtccgccgacggaccccgtatcagtgggggcgctgccaccagtgatggcgggcgggtcggtcggcgtctaggccccgcccgatggtcgcctggtctacctcgcaggcccgtgctgttgccgaggccgagaacgtctgcccacttgttgccgattcagtcccctctccgtctgccatgtcgccaacctttcctatctggcgtgctcatggacatgcccgggcacgccctcgctgctcagaggcctgctcgttccacctctggccgcgaaccgtatttctgctgaccactcctcgtgcgtgaatatttgccagccttggccattcatatttggactactctgcaccagatatcggactgggaaacctcttgcacatctctaattgtcatctattcgttgggcgcgcgctgttagatcgtgatcataccaatcagaagacaaagcgacgcccttttgagcggcttttcgaacgattctagaccgcgctatatcagcatttctaccgcgcggccagagtgctacactaaattcctctctgcaatccttaagtccattctttacttcctcatccaatttctgcgacagcatttttatggaagcatcgcactctgactcatcatcaaatgcctcaattgcgtgcgttcgccattcacggcgcgtattatcgtagccgtaatgaagtattacccaccgatccacagaatcatcgttaggatctacaactgtcatgaatggcccaactctcgctctggtgtattctcaattgcagttcagtgactttacttgaccagtcccggatttagtagacgtagacggagagtaccccgccgggaacttgactgacatcactgctgtaccgtactgctttcccgggtggcaaccatcgtaagcagcatttgccgtgacgtacctagtgctctttctctgagtgccggtaatcgccttatatggtacaggtgggtgaatcgtagccgttacggctaccgatgacacgtttgcatcacatgaagctgtggcgacataattagttgtcccattgacatgatgagagtcgtggacatactgtcgaggatcgagagtgcaggttattgttgacgccgttgttctggtaccagctgctttcgagctctttgttgcagttacagtctgcggccctgaaggttttactgacgcgactgatgtgttcgcgtgttttgcggcagtgctttgatttggttgtgcttgtgtagcagttgctgatgtcgccagtgatgcccccattaccatagctgtgattatggcgtagtctttacgcttcattgcgcccccaaataagcatgttagtttgctattttgaataggatacgagacatcgccatgacttgtcaagggcagaagtagaaagaatcggggggtatcaagaaagatgtgctttcatcaggacgaaagcggatgggtccgttcgacttggtgacgaatgatccggccttgcgtcgcggagaccaggccggcgagtttgtcgagcagggccgccgtggcctcatcgtcgggcacatcactaaagggacgaacaaccatgacggctagggccagaaacgaccggaactgaatcgcatgtggacccccatctggcaccaggcacacacctaccgaccggaaaccctgcaccctgtcgctcccagttcacctcctaatatgcgcctatagtctgtgctagtagacattattttgtgtgttgtttcccatctggcatgtctggccccggacccgccgcgacacgcggtggtggataacagaccaggacccccggaccatagagaccagggggacgagacagtcccccggtgaggatgtctcgatgtgcagatcaggaacagaatcgccgggcacgacccggcgccggtgccggtgcagtgaacccgtggcccatcgactccacgaacgaacgtctcgccttcctcaactggtgttggcggcaaggctactcagcagccatcgtggaaacgatggacgccgcgggagcctacgaccacctcgacgacgaccagaccagcaaccagcacgactaacgccgctcccagcacgggggaaggcggcgcaccaggtgcgccgccttcccccgtgctggtgtctcgtcggcttactggtgggggtcgtaggggaacccgtaggtgtgttccagggccttgcggagaaggtcgttcatagttgtgtgttcggcgacggccttcatcttcagcgccgtgtgggtggcggtgggtagcttgacgttgaacgcggtgatcggggtcttggccgactggaaggtttcagagacactggctccctggctggccgccatttggtcggcgtaacggctggctttgtcggcggcggtgggtttgcggttcttactcacttcagcatctccttgattcggtcggcaacctgggcgaactctcctagatctgttggccgggttccgatggcttgccgataggcgacccgtcgatgaacctccgcatcgagaacgtctaggccctcaacggcggcggccccctcgtgggcatcacggtattgcctggtccaatcggctttgttgaagagcagggcccggcgtgtgccgtgggccacctggtaggtcattagcgctcggtccatgtccaggtcccccgactcggtcgggatgatgaccacatcggcgatgtcgagggctgcggtgatcgtctgagagtcaccggggggagtgtcgatgatgacaaggtcggcgtcgatgtcacggcagcgcctgacgataggggcattagccgggcggacctcgaagcccagcgggtcaccagtctcgaaagcgtcggtagcccatgacgtcgccgatccttgcgggtcggcgtcaagcaagatgactcggtactgagctgctaaggccgttgccaggtagaccgccgtggtcgttttcccgaccccgcccttggtgttgacaatagaaatactacgcataaatacatcattacacatgcgcatcgatgtatctgtatatatgtgtatcggcgtgttgcgaggggaaaccccagcccacatacaacgatcccccagccaccacagccgggggatctctcagtaaagccagcaactcccacagaagttgcacccccacgatacccaccacatccgtgtcaagcccccacaacacccaccagcgccctaggcttcccccatgaacattgacatggacgcaccaaccgaaaccgaagccgacaccttcgatgccgtcctcgccgacattaaccacatcaaccgcctcaccgccgacgaaatcgaggactactccatgggagcctgcctcctcctcaaccaccaccccttctccgaactccgccaacactgggccgacaaccccaccgacgaaaccacgtggaccctctacgggaccatcatcgccgcctccaccctggacccccacctcagcatcgacgccctcgcccgcttctaccaactccccc

SEQ ID NO: 201 - DNA, 4261 bp, Propionibacterium acnes
gacgccggccaccccaactactccgacccacacggtgaccccagctccggcctctgccggccactcgaccagcgacgagcacccactccatacggataccgccacagcggacaaggccagcaacgaggacgccctgtccccaatccaggtgggcttgaccgccagcgtcggactggtgctggtcgccggactgatcaccaccctcaaccgccgctaccggacccggttcacccgccagccccgcggcaaggccatgaccctgcccagcccggacgcccaaactgccgagatagcgctgcgcagcaccggggcgactgacactctgacgatcacctgcctcgaccaggcgctccgcgcgatcggcgcatggtgccaccactgcgggcacccgctgccacccctgctggccgcccgcgtcgatgacgaccggatcgacctgctgctatcccaggcggcccccgaccatcccgaggcggtggagctggccgccgacggatcggtgtggaccctcaccgccgaccggatcgacgacctgctagcccacaccgatgacaaccaagcggctccgtggccgtctctggtcacactgggacgcgacgacgacggcgcccacatcctcatcgacttggaagccgcaggaaccttgcacctgatcgccgatgacgaccaggtcgacgcggccctcgccgcgatcgccgtggaactggccacctgcgactggtccgacgaagtcaacgtcaccctcgtcggccaggtgtgcccgggcctagaagacgcactagagtctccgaccctgacccgcgccaccgacgtggacaccctcctcaccaccctagaagctcgcgccgacgaccagcgacacatcctcaccgaaggaaaccccctcgccgctcaccgagccgaccccgccatctccgacgggttcgacgccgaagtgatcctcctcgacaccgaactcaccgaagaccaccgcaaccgcctcgccagcctcgtcgaggctcttccccgcgtgtcagtcgccgcggtaacaaccagccccaccagcccagacgaatggtccctcaccctgacaggtgacccactagccgccgacctggctcccctcggctggcacatccacccccaaaccctctcccccgacctgtacaaccgcatggttgaactactcgccaactccgccgccgcagactacgaacccgccagctggtggaaccacgacgccgacgacgagcccaccaccgaccccaccaacgaggaagaatctaccccgagcaggcgagcccgcccgaatatccgcctgaccaccctgaccggcggcatcgacctatccagcgtcgacatcgacgacatcatcgacgaagccaaccaggccctcgacaacaccgaccagaccaccaaccagaccaccaaccaggttcgcgtcgacaccgaccaacccggcaccgacacccccttccccatcgacgacatcgacccgctgagctccgaccacccggtcctatccatcatcggccaccccgacatcacaggtgccactggaaccgttgggcgctccccgtggcgctgccaacagttggccctctacatcgctgagcatccgggagcatcgggggcgactatcgccgatgatttggggctatcagcgtcgacggtgcgctcgattgctacacacctgcgacactggttgggagccgacgatgccggggtggcttacatgccggcggcgacgcgcggctaccgtctcgatgagcggatcgtcacagatgtggacctgatcgacgctgctgtggccggggcaggcattaacaccgctgagacggccacactggtggccattttgaagctgggccgcggacgggtcttcgctggggttcctgactcggaacttcgccagttcagggcgtcgatgtaccacgtggaggcccgcatcgtcgatgctgccctccaagtgacagaccgggccctggaagccggggacctggggctggcccggtgggcgttgacccaagggctactggtgtctcccgatcatgaggacctggtcaccggttgtctgcgcaccgagtaccaggccggcaacatggacaaggtttccgagctggtcgatcacctgtcggctaccgcacgacgcctgggcgtcgatttgagcgccgacaccacccggatcatcgactccgttattacccatacacgcaggagagcatcatgatctcccgttgcactcatctccgtcaggaaggttcctatgcaccattatcgtcttggtatcggcactgccctcatcgcggtagcagccgtggccggctgtcgctcaacagactcgacacccacaccacctccatcccgtgtctccgccacgacatcagcgagctctaccctcagcccgaccccgtcagccggagcgatcagtgccgccgacgccgaaaacatctaccgcaccgtccaagctaacaagatcgcactgtacaaaaagggtggcctggcacccggggaacccgcacccgcgacactgtcgaactacgccaccggccaggctctcaccgactacatgacctacatgcaccaaatctcggggcagggcatcaaaatcacatcggggaactcctcggttaccgcggtgcgggagaaaaagggtgataccacctaccccgaagccgctatcgccttggaatcgtgcgaagacgacagttcgattcgtaccgtggaccgccacggaaaggctgatcatggacgcattttccatgtcgacagttggtatgcccgcgataagaagggcaccgtcaagatgatcgcattcaactcaacggaggtccccacatgcgacgtcaagtaatcaccgcggccgtactgggcctggccctggccaccacctccctgcccgccctcgcaggcggcggcgacttgaacggcagtgtggacacggatggccctggttacgatgtgcgtactgaggtggattaccatcacaccaccggtggtgcgggtgggggtgccacgacagggggccatcatgggggcaaaacccacggtgatggtgaaggtgaggctattgatgggcgttctcgcgccgatgccgaagccgaactagacgaagccgaccgtaaccaggacttgacttgtgatgtcttgctcccaccggcgccgaataccccagccggccaggaatgggcgaaagaatgcaatcccccagcgaaaaaggggcagaaggccaccccgaagcccgatccggtgttagtgggccgtcacgcggccttgcagctcacccttcccggcgcggcccctcgtatcgatccgtcccccgaccttaaccggtggcactcggcagcagtgggccaggctttgtggttgtcggttgatgaccccaccgccactacgcagaaatcgatcacgtttatgggccaggttgtctcgttgagcgccaaacgtaacggtttgtcgtttgatatgggtgatggtcatgtcgtgcactgtgatgccacgacgacatggacggagtcggtggaaccggggaccccctcacccacgtgcggttacacctaccaacaggcagccccggccgggggctataaggtcaccgcaatcacgtcgtgggatgtgacctggtcggtactaggacacacgggcacagtccacatccagaaggccggtgggcagatgcttccggtcggcgagttggagtctgttgttacacggcgatgactcctgatagtccgacgctgtatgaggtgttggaggtctgccctgatgccactgatgaccagatcaagacggcgtggcgtcgtgccgcgaaagtgactcaccctgatgccggtggcactagtgaggcgttcgcggccgcccggcacgcctgggaggtgttgtctgatcctgcccggcgcaccgcctacgatgccgacctggcgggggaggatgatcccgacgacgaagccgccgacgccttcgacgttgatccgttcacggcatggccctggtgcgccccgtacatcgacgccacccccaccctgcgccacacctgccccggcacgatcaaggccatcgtggtcgccatcgccgggatcatggccggaatcggctggcaggaagcgctggaggccgtggtgtcgccgccggggtttctgggggcgtgctggatagtctcagtgccggttgtcgtcgcagtgacatggctggcagcggtgacgggtctggcatttttcaccatggcggccatctggtgtggatggtcgttgataggtggtgcgttgctgtggggccagacgtc

SEQ ID NO: 202 - DNA, 12448 bp, Propionibacterium acnes
cccatcgtttacatcctcgactggtccctgcgaccagtgaaccgtgcccccactgcgcccacaatgatcagcacacccacggcgatcatcaggtgggcagcactaactgatcccaacggaccaagatcaaacaagccctgcccgggagcgtcgagcagtccgtgggcgcgaagccatgctccgagatgaccgatgattttaggggccatcttcttcagcagggctatccctccgataccaacaacgatgaaggcgaggatttcttcgcatccgttgtttccttctccggtggggccgttcatgctgccttctcggggtggacggccagccagccgatgaggttgtcggcgatctgccctgagatttggatcagttcgacttgcccggcctgccatgcccgcgatgcgccggccagcaatgatgctgggacccctactgcgcggccacgggatgcaacctcagccaaggcggcgcgtaactcctcgacggtgctttcgatgtaccaactgccgtcagtactagtctcagcggcatcggtggtagcgataagagcatcggtgaggtcgtcgacggcgcggtccagatcagcgatgtccggtagggctacagcagtcatggtgtgtcttccttctagggtgccttcactggtgaagggtccctagccccggccgatgtgcggtgctgtgggaaaaatgcttcccattggtccgtcttagttaggaaacttggcctaagtgctgtcgagggtcgcgtgttcgtgaccggttcgaagacactgccgctttgccttcttgtcagtggcgtttccgagatggggtcagtgggcgatggctaggccgatgagggcgccgctgcacaggctgggtgcccaggggaggaatcgggtggtgtggtgtcggaaccggtcgattagggcatatagggcgatcagggtgaggccggctatgaccgtggcgtggatcgtgtcgatgccggttgctgcgaccggggctgcccacagtggtgtgatgcgcacgtcggagaagccgaagccgcctcgggagatgagccaggcgatcatccacgctgcgaagatgatggtggtagcgatgacagcacgtgttgccgcagtctggtccgagagggcggtaacggctacagccccgatccatccggcccatccggtccacgctagggctgccggtatccatgtggtgatggcgtcaatgacggcaacccatgccccgatggtggctagcagggcccacgtcggccacgtgggtgctggggcccacattgtggcggcgatcatggtgaccgcagccgcggcacagaccgcgatcaagcttcggagactgtaggtgtcgcggtaggcgattttgtcgggggtggcggtggccggttcgggcaggatgcgagtgagggagggccatcctgcggtcgcaatggtcacgacggcggcgatccacacgatctggtgcatgggtctcatcatggcccaatatcgatgggtgtgggtggccgacatgggctcagtcgtcgagaggtttgcgggcggttgtggcttcttgggtgccgaggatgagggtgccggagtcgtcgccggctgattcccagtcgacgatgacctggtcgccgtcaacgctggattcggcgatggtcacccattgcccgtccatgtcgatgagcatcccggcggccaggtctgtgacggcaaccgggtggggtgggctgtagaggaggtcgatgtcgcgggcagggtcgtcgggttcttcggttacctcgggtggggtcgatctggctgtctcggtgtcgtcggccaggtccgctcccaggatgcgttcccattcggggctggttttcttgcccgctgaggccatcgtctcgtcgatctgttcgtcagtgggccacacaaatttctttttggtccaggtcgtggtgtcgggtcgcagctgatccagcagttccaggtcttgcggggagtgggccttgcgggggtcgggggtgtagaagaattggacttccttgggggctgattcgccggataggtaggtgcctcggccgcgtttgccgaacgggatgcccacgccgatgtgttcggagccgaacatcatgcgggctccgtcagcggacaggggtccggtggcggcacgcccggagaagttgtctcggatttcgccgcccaggaactcggcgtcggggcgttgggtccccagatcgacgtggatacggcaggcggctgccatgcgcagcagggagccgatccagccgaaaacggggcattctccgggcatcccagagaccttgatcgttgaccaccagtttttcgcgttgccgtagaactggcggtactcgtcgatgaggaccagcacgcgggtgaagtcggtctcgcgggccccttcttcttcgatgcggcggtagcggtcctccatgagagaccacagccagtggatgagggcgacctggtcggggacggtagtggcgaccatctcgatgttgggccactcccgcaggcccaggtactcgatgcgtttagggtcgatgacgaagacgcgccagttgcggcgggcaccctcgacggcgtcgccgatcatggacaccgtttttccggtacgggtgcggccggccttgagctggtgggccatgacaccggagatgtcccagaaacaggtgttgccgtcctcgtcgacggcctgggggattttctcccagtctggggagtctgggcccggaagggccacgggtcggggcaccatcgagggcagggggtggcggcgggtgacggtgatggtgtcgtgttccaggtcgaagtcgctgcgccactggccgagcatcatcgccgaggtcaccgcggccaggcgcaattggatgttcgggctggacaaatgggcgccacgttggtggtgaatggtgaagccgtccaggttcccccgatcggttttccaggaatcgacggtgaccgccgacccatagatctgagtggctacttctttagcccgttccttgtctcggtccagatcggttttgtcagggtcaggggtcggggcgcggtattgcaggacgaaccggccggccgggatcgttgcggatgtcaccgtgaactctgccggcgaccaggcagccgcggccgcctgggtgagggccattggcatggtctcgacggcagcctcctcgggggggatggtgagggtcaggcgtcgcggatgcgtcttcttgcgattccatgtgactttctgcttcaccggcaccttcgccgccgactgaatggctaggcgagctgattcggcagtttcggtacgccggccagcgcgtagcgcccgtcgtgcgtgaaggctgcccaccacagcacagcccatacacggcagccaccagcgcggatcagcggctgctgcatagcccccggtagctagtaccgcacctgaccagccggccgcgatacttttccacgccggtttcgcgccaccaggaccagcgttatggacggtctgcttcgaggctgcggagggacgagacagcggagtgctggtcatgccgcggcctccttgtggcaggtcatttcacaggcatgccggccagcgatgatgccgtggcgcaccgccccggtagccgcatagaccgcgcacaactcaaacacggggcacccatcgcaggccgccgggttcatgctttctttgtcccacgatggtgggtcatcggtgcacggcacggccaggccatcctgttgagcggcgctgatagcggtgaataggcgcagctgggcgcgaacttggtctggggtcaggttgacggtgcgggctacacgcatggggttccttcctcttcaccagtgaaggttccctagacccggccgatgtgcggagggatttcagtgttttatcgaggtgaccagccagccggtctgcgctgcgggttcaggtaccagggtcagatgcagcatggtgtggtcggctaggggcacggcgaccaggggcccgtcggcgctcgccccggtgagggtgggagttccggccacggtggtggcgggaatctggttgggtttcgcggccatcagggagcccatgagggtcggggcggcgatctggacgagggcgactttgcgggcggcgggatcgcgggtcaaccagccgcgggtgaaggtgagcgcagccgacgtgatatcggggctcagcggggctggtgtggcggcggggtgggccgttgaggagggccatacgcgcggtagcgctggcgacatcgagcgggtcggagtggggtcaggtgtagggcttagggtccgatgtggcgatggggctaccgccccggtggtgggagacgagactggttgggggtggtgttgagggcgtgggatcagggtgaaggcagccaaactggccgggatgaggatgacggccgcgccgacacttcggagcgaggtcatgtgacgatccttcggtagctcgacgggttgccgtagatcttttccacgttgatgccactatgtgggttgtcggcgctaaccatttggcctccaccgatgtagacggccacgtggtgggcagggcttccccagaggatgaggtcgccgactttgagctggtcacgggccaccgcggtgccgactttctgctggtcggcggcggtgcggggaaggctaatgccgatacgccggtacagcgccgaggtcaggcctgagcagtcgtagccgccatcggctttgccgttgccaccccacacgtaggcgtaggagttgttgtcggcgatcgatttggcccatgccacggcttcggccaggttcttcgacacaccggtctcgttagcggccccggtggcacagttgtttgacaggtgccctgtagtagtggatcccactatttgtttggccatggtttcccatttggcgtaggcatcgggcagggctgagccttgcactgcctgagctgcctgcgtcagcggcatcttctgccagtcagcgatgtcgactaaaccgggaatgtggaatccagggccgccggccgatccggggccagcgtaggtgatggtgtggcctttcaagaacgcctcggtggcgtaggcatcattgttgacctgatccagagtcccgtaccagcccggcaggatgcgctgctgaaaggggccggcgtcaccgtcaccgttagccttcgctgaggtagggtcggccccaagatctgattcttgtttggcggtcatgatagcgatgaccgctgcctgggtaggcagtttgtcacgctggaccacagtgacgatggtggtcacgagctgcttctgcctggccgtgaggcctccggcacccacagtgcctccggtgacggtacccacgcaagcatccccgccgacactgccaccgccgccgccagagttgtcgtcgagggccccagagcctactgacagcagcggcacaatgatcacggtcgcgggcaagaccgccaggcccgccagcatcagcactgctgcactcaccacggcgatcacgtgagatgctttcaacgctgcccacctttcgctggtttgagggggcgacgcctgctggtacgcacaggcttggttggtccagtccgccgttggttggcaggcctgggtttgatcggcttgctgggacccggtttgggctccggagtcttaggctccggcttcacatgcctaggcacttcggctgcggtgggaggagtcagcacgtggcgtaccggcttggtgaccttctgggcacccgaaacaaccggcttagacaccaccttggcacctttgaccaccggtgcggctgccttcgcgccggccttcttgactgcacgatgcgctttgatagccccggcctcggcccggccaaccctgctagcagtagcatcgagggctctgtggcccgtcgttgccctcaccggtgcatccttgccctggcgggtctgcttagcgatcgccgacatgccgcctcgcaatgccgaaacatgattgtgggcgtgggcgatcgccgacatgccggccgtcgcgatttttgactggccctgcggggcccctgccccagcacgaatctgctggtaagccgccgacgtgccacgagcacccgccgccattcgcgccaccttcgcagccctagtcactcccgtcgacacgccacccgtggctaccgcagcagcacccgagaccacagtcgaggccatccgccttcgacccaatccggtgagcttgcgaccaccgctgcgcaccatccggcgagcaccccgcccagcccactggccaatcgccgacgccccttcggaacgcttgctgcgcatccaatcgttgatcttgtccctcagccccttctcgcccttgtgacgacgccacatggacatcaagaacccgataatccccacgagctcgagcatgttgacaaccatgaccttgatggcgacatcaccgtcagaggcgaaaaccgacttgatgatgagcatgaccacacccaacatcaccatcgacccgacaatgccgatcatcgagtacaagatcgaacacagatcccggatgagcggatctgtgcggccagggatagcccgcaacacgttgagcatcgacatgaacgccgaccacaccaacttgcacacgtagaaccagcacatgcccgcgaacaccagcaggaccacagccaaacccgccaccgtcgacgagtaaaagaagaaccccaccaaccacgaaccatccgcaatatcgccggcgtaatccgacaacccctcatcacagtcaccaaggtcgtcgcgagcatccgagacgtcatcgtaagggccacccttgagcacctcgatgtacttgtcgtggcacttcgcatcaataatgcggccatagttgagctgctgatgaaccggcgccacgaacgagtccacaatgatcgccgacagcttcggatccttcgagtctcccgtcgaggtcatgtcatcaggaatctcgacctcaccagcggtcgccgtcgcaggatcaaccgaactggtaatcatatgagacagcgccacaccgaactgctgggtgcgagccagcggagtagccaacgtcgtcgtatcgcctgcgaacttcgccaccggggccgccaagaaacccaacgccagcgccgcagcaatcgccgcacgcgcacccgtagcccacgcccctgccgtacgtcccctcatcatcttgacgaccacgcccacaccggcgcacgtcgtcagcaacgtcaacaccgttccaccccagctgtccgctcccagcggggccaaaaccttgtcgtggatgtcgttctgtaaccccaccagcggtccggtaatccacccgacccagctcatcgccacggtccagtccaacaaccggcacaacagggcaatgaccatcaggtacgtgttccaacacatgccaataatggaggcccacatagccttcagcggggccgtaacgccaccatcgtccatcgacatctggtactgaaacaagtgaataccgttggagtcagtcacattgaaaccgtcacccatccagcccagccccgggcccgatgccatggcaggcacactgctcagcgccaccaccagaaccagcgtggtgacgatgatacggaaccgccgctccccggccccggggcggcgtggatgacggctcacgctgtctcctggtcgtgctcgggcgggttggagctggcggcttcgcggtggggagcgtaggcaggtctcagtagtcgaatttcaccgacgttgccgtgttggtcggcgtacaggccacaaccggggcctccggggttgagggcaatcttgaccaggtcagcgaactcttcaggggacgttttagggtccacgcccaggaactcgacacctttctgggcgaggttgatgttgtcgcacagcaacacgatgcgatgctgaatgaggttgcggacggtctcgttggggtaatcggcctcggggtcgtgggagccggtgataagccaggcattggctcggcgggattcgcgcacgtactcgtcaatggcgtgggaggcttccggcgaggacgacatgtgatgaaactcgtcaacaatgaaagcggcgtcgcgggcccggtcgctgaagcacaccaggcgagccagacgggcaatgagcgcgtagagggctcggccaaacaccttgtgcgggggcagctgccgaaacagatgttctgacagcatctcctcggcgttaggaagagcgatgccacaagtgccaatgatgaggatgtcggcactcaggtcggcgggaggaaggtccgggtcaaagatggccgaagctagggaggccgagttctcgatgtcagcgaacacggcaatcctgtcagcgatcgcggtggcctcgggaaggtcgcactcctcggccaggtggcgggccaaacgcccacacgaggtgatctggtggtcacgcatgtaggccggtttgaggaccttggccagcgtggtcccggccacaccgatggtctccaagttaagcaaggtcagcaagaacgactgggcgacctgcccggccatctccgggggaaggatgcgcagcgggtccagcgacagcttggggtgggccgtgtcgacgatctggcgtctaaccccgtcgatagagttgacaaaggttacccactcccgctcatcggagttgtcggtggcaataatgcgcccgccccgggccgcgatggctgcgcacagccgcttctcggccatcgtcttgcccgcgcccatcttgccgatgaacgccaccgtgttgcctttctgatcctgagtgtcggcatgcaaatcgaggtaggccagcgactgcaacggggagcctgtgaccacagccaacgggatgccggtggtacggcccaaccggtactcaaccaccgggatagatgcggcgaacgcggaggcgtgagtcagctgacggtaggcgttaagcgaggaggagaaccggccaccgggccgggcagcccacagcaagtcctcctgacggcccacgggacgcacccacgtgaagtcaccgaacaccggatcattgacgaacgctcctgccagctcctcggtggtctcaaagtcaggagacgagacagtgacggtgataagagcctggatctcgacctcacgctcatcggcggccagctcggcgttgtagtcgacgagcacctgagcggaatgctcgatagacatgagggtcgaagcctgggtcatctcaccgccctcgacgttgtcgagctgatcgaccgtttgacggatagcccgctgatttttctgcatcgcagcgtgacgggtccgggccactccccggatcgccacgtcgaccggcacgccagtgtcgtcgatacggcccaaaaactcgtaggcaggccacgtcatcgtgcggggcaccttacccagcacgatatgggactggtagacggtctcgccggtgtcggcaccgattttgaggacgcgacgattccacgcctgagccgtccgggacatgtgggagactcgcttgtcatcctcgctggccagcaggtcggaggtcgcggcctcatcgatgaccaactcccccagcgcggcacgtccaacctcatccatgagggcgattccctcgccaggggcatcatcacgcaaccgggtcgggtggcctgacaggtgctgccgaagccagatctgttcatcaacggtgaccgggcggggttggaacgctgccggcagtttcgcaccgaattccttagcctgacggagggcccactcccgtgcgacacggccaggagcggtggtcatgagtccggcggcttcggtgattttgttgagggcggcggtccaggcggtgtgggtgcgtattttctggtcttggttgagtttgatcgataggaaccacacgcgccggcctagggattcggtttcaggctggtcgagggtggcgtcgatttcgtcggcccacacggggtgttcgctcaggtcgaggccggcggccatggcgtcgacgatttctgtggggtcggtccaggtgagggctccgttgaggcagaactcgtggcgggcgaggtggcggaataggtcgcggtgagctgcggcgacggtgagggaggcgttctcggtgacgggtcgctggaggggagtgagtcgccaggtggcccagatgtcgccggtggaggtccagacgaggttgtcgaagaggaaccgttcggggatggacatcatgactccttttcggcggcggcgaggaaggcttccaggccgctgcggcgtacagcgttcccggtagggtgcaggggttttctgggggtgggttcagatttcgaatgtgggaggggtttgtggatggtatcggtgtcctcggcgagggcttggtcgagcaggcaggtggccggggtgtcggtagtctcgtccagctcgtcgatcatctcgtcgaggaggttgggggtggtggatgcggcccacacaggtgggatagccggtgcgggtcgaggcggtgtggggaggcggagtttggtttggccccagaggggtgtgtgggtcatgccggcgggagtggtggcggcgtgagtggtcacacgccaccagcccgccagccatgccagaggtgaccaggtccagtcgatgcgaccaacaacgaactgggcgagccatccggcagccagcgcgaaaatgaaaccgcggatggtcatgcccccgtcgataattttgaagcccatcattgcggcaggaactacgccgccgacagcgagcacctgatagatcgtgtagggcccgccaggaatccttcgacctgaggaatccttaccgataatgcggggctgctggcgggcctcggtgtgccactgaatatccacgatcagctcttgcccaatccttgcatcatctgtccgaagaattggatcgcgttaccttcgataagccagtgcgccataccacacacaaacagcatggagacgatcttggccaggctcataccgtgtttgaagatgttgaacgcggcaatgcccacgactacgaccatggcgacggctcgcaccgcggactgaccttcacctgccttgatcgtcgtccattcgaagaggttctgcgattccagtggcagcaggaggaattgatcgagcatgagaggttttcctttcaggaagccgaccgggatggtcccggtactgacgggctggacggcacgggtgtgccggccaggggcagaaggcgtgacggctggtcgagggaggcaacctcccagcggcctgcacggctgacaagagtcaggccgtactggctggtccgggtagtggattcgtcgccggtgggctggcatgtcacggtcaccgtgacggtaatcttctgccggtctgagggggtggggacctcgtcaggtcccaccacatgagtggttttcactgatacgcatggggctgggtcaaccgcggtgaaagcggtccctgggctgctccatctcgacaggtcagtattcccggtcagcatggcggttaggaagcctgaagaggcttgggcggccgggtcggcggtgcgaagctccgaggtgtctaaggtgggggccgaggccggtgcaggcatggggatctgtccaggtagacgcaaggcgatggccttgccgttggaatcgacgtggaccgggactgaccaggcctgtccgctcccggattggccgcccatggtgaccacggtgacctgccacaggctcggatcagacggggagacggtagcgtcataggcggtgacggtggtgggcgctggaccaggtttgcggggcatgcgcgcatcggtgatcttggccgccaccaggtgttccagattgtccaagtgcccggagtcagaggtcagcagaagagtagtcacctcgaccgcggtggctgaggcgatctgagctgtgcggcggtcgtgatgggtggtgtcagtgctgacagctgtggtgggagcggatgccggggccgccgaacggaccagggcaacggggccgcatgcgactccgcacagcacgagggcaaggaagcctttggtggccatcgatccggtgtggggccagggacccacgttttcctgtgcctgttttttcttggccgaccaacggcgggacttagggttagcggatgcaccttctggggtgcatgctcgtctcaatcgcatcggtcacctccttcactggatgaagggaccaaggaggtgaccgatgtgcggtcgaacccgaaaaagttcaaacttttttctgggtctgcctcaagtacgacagaaggcctgcatcatcacggcgttgtggtagcagatcttgcgtcagcgcaaatgtatgggcctcgtaggagtagctcttaggtgggtcccggtggttgcggccagggcgagggtgtcgggtatgtgtagcgctagtcccgggttcgtggtgtgagggcttttgggtgctgacatgcactacccattgctagacgctgtgctgtggcatggctggacgtctagcagacgggttgacatcacctttaggctggcagcgcccgaggccgcaggccagaggaagcggacagcctaacgattgacgtccccctctcctttccccaacctcctgga

SEQ ID NO: 203 - DNA, 9476 bp, Propionibacterium acnes
tgtgtgggatcagctgtgccgctcccccgacatggcagacagcaccgttgcatgagaactgactgacactgtggcgccgcggaggtctcccgcggcgtccgctggggcgagtgcatgcctgtcagctcatcttttatcgtcatgtttccccttgtcagagcggtctttgcaaagtgacaacgtcaggggtcttgacgacaacatcctcgacaacatcgtggcggtggtctgtgtctcgtcagttcaacgcaccggggaaagaggcaccgctgatgttcaccaccacaaacaccctcaacgatgagtgggaccagattcgcgccactgagatcgattggcatgactgccctgaactgatgcactgcatcgacgttgatgatgtgttggccgtcattcctgccgcccccgacgccatcttgggctacctcattgcccgggctcagggcggtgacgagttggccacccgcactatcatccaagcgttcacaggcaagcttatcttgatggccacggccaccaaggtgcgccgtactaatgacggcttcaatgatctgttggcgggtctgtgggagacgatcatcacgtacccgttggatcgtcgccctgacaagatcgctgcgaacctcatcctcgacacgttgcaccgggttacccggttctggcgtgctgattcccccgatgaggaagaggctcacggtctggtgcccttccctgacactctcatcgccccagagcccgatgaggacgtcacagctagccaggccatcgccttggcggtggaccgcaactggattaccgaggacctagcccgcctcatgagccatatttactgtgacggtatgactggagctgatgcgggtcgtctgcatggctgcgctccagctacggtgcgatctcgatgccgtgatggtcgggccgtgttgcagcgcaacgccgagacgatcctggccgtctgctgatccctctcttgctcatgcctgccgccaccctacccctacctgctagaaacatagccatgtctccagcaacgcatctagcatatcttctagcaattgatctagctatgtatatagctgatgatctagctatcatatagctgtgtctccagcccaaaggacagcccaatggcatgcttgccacaggaaggtgcgtcagcctcccgaaatactggaaggagctttaccgtgcaggacatgacctcgaccagaccgattgaccgatccccgttcgaccgcactattgcggtgtggaaccacaaaggcggcacgttcaagacgtccgtcgtggcgaacctgggatacctgttcgccgccggtggcaacaaggtgctgctggtcgacatggacccccaggccaatctcgacattgacttcggtatacccgcgggagaacgtgaacggggcatgggattagccgaggcgctacgtgaggggacggcccttcccccaccgcagcatctcagcgaaaaccttcacctggtcagtggcggcgctgctctcaacgagttcaccgaccccgcatccttagcggccatcctcgaccgagtcaccaccgcacgctacgacctgctagctcaggcccttgccccgctggcctgggactatgacctcatcttcatcgactccgggccggcacaaactctgctgtcccagaccatccttggagtagcccgctggctggtagtgcccacccgcaccgataacgcctcaatcactggcctcgtcgacgttcaagacgccatcgacggggttgcctcctgcaaccctgaccttcaactactcggcgttgtcctagccggcgtgggggcccgggccacccggatcgccgcagataaacgccacgccatcgacacagtgctgggggcaggaaccgttttcgatgcggtcatccactactccgagaaggtgtccgtgctcgcacgccagcagggcaagaccgtcgccgagctagccaacgagtaccacaacacccagcccgcctacacctacctagctaaaggccagaacatccccaacgtcgccaaggcagccgtcagcatcgaaactgattatctgaggctggccaccgagatcagcgaccgcatgttcaccagcgacgagcaggagcctgatcatgactgacgatccgactccatccgagcagaacaaccccaccagcgacgacatgcgcttggccgaagaatgggccaacagcggccgcacagtgggagccctgccgcgccgtcaacggcctcagcgacccacaccccgcaccaccagccaaccccctgtctcgtcccctgacacaccggctccgaaaaaaccccagaagacccccaccagccagcctggccgtcaacggatcaacgtcaccgtctacgttgtgcccgaactccatgagcggctgcgctcccgatcggcggcgacgggggtgacggtctcggatctggtggtgcatgcgttagcgttcgtcgccgatcatgcgggggaggcgatcgccgatgatctgcgcgtcgagacgggccccggcatgggggccggactgttcgatgtgaccccatcgcggccagtaggggtcgccaaaacccagctgggggtgcgaatgacccgccacaacaaggatggtttggaccagctgacccggacgagtggagcccgtgaccgcagccatcttgtgtctgtcgccgtgcgcgactatctcgactccaaccctgtaaagaaaggccgacatgtccgctgatgaaactcctgccgcccggggtgggcgacgctttgatacgaccgtcaagcccaggcgccgtcccatgcttatcgccgccggtatcgccatcgtgatagtcggcgcgctcctcatcactcagttgattcgctccgcccaaaccgagcatcgcgtgctggaagtccacgccgatgtggctcgcggcgaggtcatccgtgacaccgatctggtatcggtgactgtcggccaggtcgacaacgtatcaacggttcccgcagaccagctcgactcactggtcggcaaacgcgccacggcagatcttcgagccggatcactcttgcctgctggggctatcggcccggccgatgtcgttccagctccgggcaagtcgctggtcgggctgaagctagccgccggacagatccctatcggagaccttgctgccgggacgaagctgcgcctgatccagacgtcggcacccagcggctcatccaccaccactgatagcagcaccaataccgatggccagtcgtgggaggcaacaatggcgaccggcaccaaaaagaccgagcaggtcaccttgatcaacgccgaagtgaactcgcgtgatgccgcccggatcgcccaactgacgtcacagggccgtatcgccgtagtgaaggatccgatccgatgagcaccattgttttgaccagcgtctcgggagccccaggggtcaccacgacagcgatcgggctgggcagggtctggccacaatcgagcctggtcgtcgaggatgacacccaccacgccatgctggcgggctacctgcgagcctcccagcacgccgaaccgaacctggccgcagtggcgaacctgacgtcgactccaaccaacgcccaaacggtgtgggaatctatcgccagacccctacccaccgatgacccagtcggcgggctgcgacgcaaaggcatcctcggcccgcccacgccgtggtctcgcgcaggcatcgacccccgatggggattcatgctggccctgtggcggcaactggaggaggctggcatcgacaccatcatcgatttgggtcgcctagccacaccactgacctcaacgccacacctgatcgccgcacccatcgtcgaggacgccgacatgatcttggtgatgatcgaggcgacactacgcgacatcgccggcgcccgcacgatggtggagggactcgctgagcagatgaacttggccggcgcctaccgacgtctcggactgcttgtccaccgtggcggccaggcccgcggcgtcgccgagttcaatgacaaggagatcacctcggcgttacgactcccggtcatcggggccattacccacgacccggccggagccgcccaactctccgacggggtcgggcagcggttcgacaagtcacgtctggcccactcactatcaaaggtggcggccagcctcgtcgatgccataaacaagcgccacgctgatgacgaggaggatctgtgatggccagttttgctgataatccgttcgacaagctgcgctcccaggatgcggcaagagcttcggtagagcaggagcctgatgccggattagcgtcggagttgttttcgacgtcgtcggggtgggccagctctcagcaggtgtcccaagctcaaccggtgatgacccgttcggagaacgtggattggccggttgtcgcggagctagccagtacggccactgatgaggttgaggctgagatcagcaggtggagttccactcatgatggggtggcgacgctagacattcgccaggccatcgcggagcctgctattgcctcggcggtgtctacgtatgctgaccgacgccagatcgatgtaggggagacctggcctgatctggtacgccagcgataccgcaaggctgtgtgggatcagctgttcgggatggggcggttgcagccgctgttcgaaatcagcgacgccgaaaacatcatcgtggtgggtaaccatgaggtggttgtcgaccacaacgatggttcccggtcaacgctgccgccggtggccgactcggatgccgagctggaatcccagatcgcccggatggcgaggaatgcgaccccgcggcgagccttcgacgccgatcacaccgatgtgacgatcatgcaccaacagaagttccgtatccacgcgatctcttcggaggtgtcgttgcaaccgtcggtggtcatccgccaacatttgctcacccaaatcagtctgggggacctgtcccagcggggaatgatgccggtggaagtggcccggttcctcgatgaggcggtacaagctggcaagtccatcgtggtcgccggcgagcagggggcaggcaagacgacgtttttacgagcgttgatccacgccattccgatgcgggagcggttcgccacgttggagaccgatcaggagttgttcgctcatctgatgcctggccgggaaaacacgctggtgctgttcgcccgtgatggtaacggcgaggtggatccggcgactggcacccagcacggcgctatcgagatcgcccagctgattcctcctagcctgcgccaggcgttaactagggtcattgtcggtgaggtgcgcggcaatgaggcttcggccatgttccaggctatgcagtcggggactggcactatgagcagtatccactccccgcgagcctctgaggtgccgtcccggctagcccaaatgatttcgatgggcccggtctacgatctggatcaggccatgctgcagatcggtcattcgatcgactacatcgtctttgttcgtaagcgtgacctgcctgatgggagccggctgcgatttgttgagcagatccgttcagtctcgcctggtgattcgacaactcccagtcttggcgaggtgtacacggctgactcgtggacaggccagccgcttacgccactcatgcctggttcggccgccgacgagctgtctcacttcgcccgagacctggattactgcgaggcccactcatgaacactcccgcactaaccagcgccctcatcgtgaccgggttggggctgatcctggccatcgacgggctggtcccggcgccgcctcgacctggtgccccgctgagcccggcccagaggtgggctcggctcacccaccgtcccacaggagcggccgggcgtcgccgggatttgcgttgggggttggctgttctcgtcggcgtcgtgctgtttgtgctcaccgggtgggtggctgcgctggcgttgggccccatcattgtgttgttggcccccaccctgctgggggcggccccaccgaccgatattccgctgatggaggcgttggatcggtgggtgcgtcaggtcgctgcggtgctgccacaggggcgagacatcatcacagcggtgcggatctcacggccgcgggccccgaagctgatcgccgggtcggtggatcaactggtgtcccggttggatggccgtatggagccgagggaggcgttccagcggatggccgacgagctggactcggctgaggctgacgcggtgctggcctcactagcgttggcggccactcatccgcggggagcctcgacaacgttgaaggctattgctggcaacatccaacagcggttgaaagtgctgcggcaggtggaggctgagcggtctaagccgcgtaactcggtgcgccagatcacactggtcacgatcgccatgttcggggggctgctcgtgatcggacggtcgtttctggccccgctggcgacccctcccggtcaggtgctggtggccgtggcggtggtcatgtatgtcatcgcactagtgcagatgtatcggatggcgcggccccgtcgacgcacccggatcatggtcaggaggacccgatgaccattactgctttgtccctgctggccggggccatcgtcactgtcggactgctggtcatcgtggcagcgttccgcccagccccaggccctgacctggttgccgctctggaggtggtgtcgggtcgcacctcaagcgtcgccgagaacgtcgaccagacccggatcgggcggataggtcgcagcgtgacccgcacattccatgtgtcggtgtccccggccatgcgggccgcactgcgactccaaggcacgacccccgaagcgttctacggtcgacgcctgatctgcgcactgatcggggcgatcctgccgtggctgctcaacgcggtagccatcgcggtaggggcgaattccccgaacctactcatcccttcggcgctgtgtgtggcgttagctggcgctggatggatgctgccggcagcacggttgaaggctgcggccgggcccaccaacgatgactcgttcgaagcgctgctggtattcatcgatttggtcgtgctggaacggctcgccaacgaaacctccgtcgacgcgctcaccaatgcggcaaacatgtcggactcgccgctattcgtccagatccgtcaagtcctcaaccgtgcctccctggaaaacgtcgacccgtggaacgggctagaccggctagccgaggacatcaaactgcccgaactcaccgatgtggtctccatcgcccgcctccaaaacgaaggcgcctccctcgtcgacagtttccgggcccgagtcgccgagttgcgcgacgcctacctgctgcgcctgcaacaagaatccaccgccatcacccagcggcttggtttgtggacgatcctgcaagccggctcggtcatgctcatcttgctgggggcggccgccctcacactcatcacagccggataaaccgacatcgtgtcgagcccccatatgggccgcgaacctttcataatgatgcctgtaagcaccacaatattgatcacaacctaacaatgaaggagaaatcatgatgaccgatctcgacctggctaaaaaacagatcacctggctggcggcgcacctgcgttcccggatcgttgacgagcgtggcggtggtagctctaccgtggagacactgatttggattggtgtcatcgtggcgctggtgattggtgtgggcgtcggggtgacggcctatatcaggtcgaagatgcctcactgacgacgatgcgtagcaggttcacaactgatcagcgtggcggtggtagcgcgtcggtggggatgctcctgctgatgcctgcgatcatgctgctggcattcggtgggatcgaggtcgggatgtggtgtcacgcccatcagtcgaccatcgcggcagcccaaagcgccgcggaggctcagcgtgtcgtccatccggtcccggggtcggcacaggaggcagcctcgcagatcactagtcatggcggggtgcgtgatacccggatatcggtcagtgatgacggggccactgtcacggtgaccgtctcaggtcgggccccatcgatgctggggctgcatcttccggctgtgtcgtcgacagcgtcgatgcccaaggagcgcctgtcgtgaggcgaagtgagcgcggtggagcaagtctaagcgtcgaggtgctcatgtgggcgccgatcgcgctggtgatcatcgggtttgttgtgggtatcggccggatgtcgatggcccaggacgcggtgaatggcgcggcgggtgctgcggcccgtgcggcgtcgttggagcgtgatggacagtcggctcagtctgcggcgcagcaggcggcgtcggcgaacctgtcgtccggtgggctggcatgtgcgccgagtgtgagcgtggacacgtcagtgtttgcccgtcctgccgggcaggcgggcacggttcacgccacggtcacgtgtgtcacctcgctgggtcttgggttcgggtcccggacggtgcacgcaacggggtctgccccggtagacacctatcgggaaaggagaggctgagatggcccgtgatgagcgtggtggcggctcggtgtcggtgtggatgctgctcatggtgccggtgattctggtcatggccggcctggtttttgacgggtcccgtcagatatcggcaacccaggcggcccaggacgcggcggttgcggcatcccgcgccggaactgatgcggcagcgacaccgcagcttgctggccacgacggggcggccgtagcagtccaagcggcccgccaggcactatctgctgccggggtggacgggtcggtgcaggaggacgggtcgaccatcacggtgaccacgtctcaaagtcggccgacagtgttcctgtcagcgatcggaatcagccaggtaagggggcatgggcaggcccatgctcagcttgtgggaccgggagaacgcccatgacagtgatacgtcgtatcggtgccctggtggcactgctggtggtgatagccggcttaccggccgggctcgtggccgcaggcgccccgctagtaccctcgggcctgtcatgggcccatgtgcggcatctgttggttaccccagacatgaccgggtcggtgctggtgtggctggtcagcctcatcggctggatcgggtgggcatggttcgccctggccgtcgcagccgaagcggtgacgatgctctcagggcagcggctgcactggcacatgcccggccctcgcctagtgcgccgagtggcagccggtcttctcattgccgcgttcgcggccgcaccggcagccacaagcacggctcacgccgccgaggccacccatgtggcggtcgccgcccaggctggaccggcacacgcggcccccgcccaggacagccccgccaccacctctcaggccccggacgcctccaccactccgaaaatctggaagacctacacggtgcgggccaacgactacctgtggaagatcgccgagcactactacggtgacggcgcc

SEQ ID NO: 204 - DNA, 12539 bp, Propionibacterium acnes
ccccaatgcccccacaacgatcagcacaccaacagcgatcatcaggtgggcagcactaactgatcccaacggaccaagatcaaacaagccctgcccgggagcgccgagcagtccgtgggcgcgaagccatgctccgagattgccaatgatcttggggatcatcttgttcagtagggctatccctccgatgccgacaacgaggaagacgaggatttcttcgcctgcgttgtttcttcctgtgtttgcggtcatgctgccttctcggggtggatggccagccagctgatgaggttgtcggtgatctgccctgagatttggatcagttcgacttgcccggcctgccatgcccgcgatgtgccggccagcaatgatgctgggacccctactgcgcggccacgggatgcaacctcagccaaggcggcgcgtaactcctcgacggtgctttcgatgtaccaactgccgtcagtactagtctcagcggcatcggtggtagcgataagagcatcggtgaggtcgtcgacggcgcggtccagatcagcgatgtccggtagggctacaggagtcatggtgtgtcttccttctagggtgccttcactggtgaaggttccctagacccggccgatgtgcggttctgtgggaaaaatgcttcccattggtccgtcttagttaggaaacttggcctaagtgctgtcgagggtcgcgtgttcgtgaccggttcgaagacactgccgccttgccttcttgcccgtggcgtttccgagatggggtcagtgggcgatggctaggccgatgagggcgccgctgcacaggctgggtgcccaggggaggaatcgggtggtgtggtgtcggcagcggtcgatgagggcatatagggcgatcagagtcagcccggctatgacagtgacctggatcgtgtcgatgccggttgctgcggccggggctgcccacagtggtgtgatgcgcacgtcggagaagccgaagccgcctcgggagatgagccaggcgatcatccacgctgcgaagatgatggcggtagcgatgacagcacgtatcgccgcagtatggtccgagagggcggtaacgactacagccccgatccatccggcccatccggtccacgctaggactgccggtatccatgtggtgatggcgtcaatgacggcaacccatgccccgatggtggctagcagggcccacgtcggccacgtgggtgctggggcccacattgtggcggcgatcatggtgaccgcagccgcggcacagaccgcgatcaagcttcggagactgtaggtgtcgcggtagacgatcttgtcggggctggcggtagctggttcgggcaggacgcgggtgagggcaggccatcctgcgaccgcaatagccgcgacggcgaccacccacacgatctgttgcatgggtctcatcatggcccatcatcgatgagtatgggtggccgacatggggtcactcgtagaggggatcgaggggtgtgcgggcgagcatggcttcctgtgtgccgagcatgagggtgccagaatcctcgccagccgattcccagtcgacgatgacctggtcgccgtcaacgctggattcggcgatggtcacccattgcccgtccatgtcgatgagcatcccggcggccagctctgtggcggcaaccgggtgggctgggctgtagaggaggtcgatgtcgcgggcagggtcgtcgggttcttcggttacctcgggtggggtcgatctggctgtctcggtgtcgtcggccaggtcggctcccaggatgcgttcccattcggggctggttttcttgcccgctgaggccatcgtctcgtcgatctgttcgtcagtgggccacacaaatttctttttggtccaggtcgtggtgtcgggtcgcagctgatccagcagttccaggtcttgcggggagtgggccttgcgggggtcgggggtgtagaagaattggacttccttgggggctgattcgccggataggtaggtgccgcggccgcgtttgccgaacgggattcccacgccgacgtgttcggagccgaacatcatgcgggctccgtcagcggacaggggtccggtggcggcacgcccggagaagttgtctcggatttcgccgcccaggaactcggcgtcggggcgttgggtccccagatcgacgtggatacggcaggcggctgccatgcgcagcagggagccgatccagccgaaaacggggcattctccgggcatcccagagaccttgatcgttgaccaccagtttttcgcgttgccgtagaactggcggtactcgtcgatgaggaccagcacgcgggtgaagtcggtctcgcgggccccttcttcttcgatgcggcggtagcggtcctccatgagagaccacagccagtggatgagggcgacctggtcggggacggtagtggcgaccatctcgatgttgggccactcccgcaggcccaggtactcgatgcgtttagggtcgatgacgaagacgcgccagttgcggcgggcaccctcgacggcgtcgccgatcatggacaccgtttttccggtacgggtgcggccggccttgagctggtgggccatgacaccggagatgtcccagaaacaggtgttgccgtcctcgtcgacggcctgggggattttctcccagtctggggagtctgggcccggaagggccacgggtcggggcaccatcgagggcagggggtggcggcgggtgacggtgatggtgtcgtgttccaggtcgaagtcgctgcgccactggccgagcatcatcgccgaggtcaccgcggccaggcgcaattggatgttcgggctggacaaatgggcgccacgttggtggtgaatggtgaagccgtccaggttcccccgatcggttttccaggaatcgacggtgaccgccgacccatagatctgagtggctacttctttagcccgttccttgtctcggtccagatcggttttgtcagggtcaggggtcggggcgcggtattgcaggacgaaccggcccgccgggatcgttgcggatgtcaccgtgaactctgccggcgaccaggcagccgcggccgcctgggtgagggccattggcatggtctcgacggcagcctcctcgggggggatggtgagggtcaggcgtcgcggatgcgtcttcttgcgattccatgtgactttctgcctcaccggcaccttcgccgccgactgaatggctaggcgagctgattcggcagtttcggtacgccggccagcgcgtagcgcccgtcgtgcgtgaaggctgcccaccacagcacagcccatacacggcagccaccagcgcggatcagcggctgctgcatagcccccggtagctagtaccgcacctgaccagccggccgcgatacttttccacgccggtttcgcaccaacagtcggggcagacgctggccgcttcgagaccgaggagggacgagacaagggagtgctggtcatgccgcggcctccttgtggcaggtcatttcacaggcatgccggccagcgatgatgccgtggcgcaccgccccggtagccgcatagaccgcgcacaactcaaacacggggcacccatcgcaggccgccgggttcatgctttctttgtcccacgatggtgggtcatcggtgcacggcacggccaggccatcctgttgagcggcgctgatagcggtgaataggcgcagctgggcgcgaacttggtctggggtcaggttgacggtgcgggctacacgcatggggttccttcctcttcaccagtgaaggttccctagacccggccgatgtgcggagggatttcagtgttttatcgaggtgaccagccagccggtctgcgctgcgggttcaggtaccagggtcagatgcaccacggtgtggtcggctaggggcacggcgaccaggggcccgtcggcgctcgccccggtgagggtgggagttccggccacggtggtggcgggaatctggttgggtttcgcggccatcagggagcccatgagggtcggggcggcgatctggacgagggcgactttgcgggcggcgggatcgcgggtcaaccagccgcgggtgaaggtgagcgcagccgacgtgatatcggggctcagcggggctggtgtggcggcggggtgggccgttgaggagggccatacgcgcggtagcgctggcgacatcgagcgggtcggagtggggtcaggtgtggggcttagggtccgatgtggcgatggggctaccgccccggtggtgggagacgagactggttgggggtggtgttgagggcgtgggatcagggtgaaggcagccaaactggccgggatgaggatgacggccgcgccgacacttcggagcgaggtcatgtgacgatccttcggtagctcgacgggttgccgtagatcttttccacgttgatgccactatgtgggttgtcggcgctaaccatttggcctccaccgatgtagacggccacgtggtgggcagggcttccccagaggatgaggtcgccgactttgagctggtcacgggccacagcagtgccgactttctgctggtcggcggcggtgcggggaaggctaatgccgatacgccggtacagcgccgaggtcaggcctgagcagtcgtagccgccatcggctttgccgttaccaccccacacgtaggcgtaggagttgttgtcggcgatcgatttggcccatgccacggcttcggccaggttcttcgacacaccggtctcgttagcggccccggtggcacagttgtttgacaggtgccctgtagtagtggatcccactatttgtttggccatggtttcccatttggcgtaggcatcgggcagggctgagccttgcactgcctgagctgcctgcgtcagcggcatcttctgccagtcagcgatgtcgactaaaccgggaatgtggaatccagggccgccggccgatccggggccagcgtaggtgatggtgtggcctttcaagaacgcctcggtggcgtaggcatcattgttgacctgatccagagtcccgtaccagcccggcaggatgcgctgctgaaaggggccggcgtcaccgtcaccgttagccttcgctgaggtagggtcggccccaagatctgattcttgtttggcggtcatgatagcgatgaccgctgcctgggtaggcagtttgtcacgctggaccacagtgacgatggtggtcacgagctgcttctgcctggccgtgaggcctccggcacccacagtgcctccggtgacggtacccacgcaagcatccccgccgacactgccaccgccgccgccagagttgtcgtcgagggccccagagcctactgacagcagcggcacaatgatcacggtcgctggcaagaccgccaggcccgccagcatcagcactgctgcactcaccacggcgatcacgtgagatgctttcaacgctgcccacctctcgctggtttgagggggcgacgcctgctggtacgcacaggcttggttgatccagtccgccgttgattggcaggcctgggtttgatcggcttgctgggacccggtttgggctccggagtcttaggctccggcttcacatgcctaggcacttcggctgcggtgggaggagtcagcacgtggcgtaccggcttggtgaccttctgggcacccgaaacaaccggcttagacaccaccttggcacctttgaccaccggtgcggctgccttcgcgccggccttcttgactgcacgatgcgctttgatagccccggcctcggcccggccaaccctactagcagtagcatcgagggctctgtggcccgtcgttgccctcaccggtgcatccttgccctggcgggtctgcttcgcgatcgccgacatgccgcctcgcaatgccgaaacatgattgtgggcgtgggcgatcgccgacatgccggccgtcgcgatttttgactggccctgcggggcccctgccccagcacgaatctgccggtaagccgccgacgtgccacgagcacccgccgccattcgcgccaccttcgcagccctagtcactcccgtcgacacgccacccgtggctaccgcagcagcacccgagaccacagtcgaggccatccgccttcgacccgatccggtgagcttgcgaccaccactgcgcaccatccggcgagcaccccgcccagcccactggccgatcaccgagcccctttcggaacgcttgctgcgcatccaatcgttgatcttgtccctcagccccttctcgcccttgtgacgacgccacatggacatcaagaacccgataatccccacgagctcgagcatgttgacaaccatgaccttgatggcgacatcaccgtcagaggcgaaaaccgacttgatgatgagcatgaccacacccaacatcaccatcgacccgacaatgccgatcatcgagtacaagatcgaacacagatcccggatgagcggatctgtgcggccagggatagcccgcaacacgttgagcatcgacataaacgccgaccacaccaacttgcacacgtagaaccagcacatgcccgcgaacaccagcaggaccacagccaaacccgccaccgtcgacgagtaaaagaagaaacccaccaaccacgaaccatccgcaatatcgccggcgtaatccgacaacccctcatcacagtcaccaaggtcgtcgcgagcatccgagacgtcatcgtaagggccacccttgagcacctcgatgtacttgtcgtggcacttcgcatcaataatccggccatagttgagctgctgatgaaccggcgccacgaacgagtccacaatgatcgccgacagcttcggatccttcgagtctcccgtcgaggtcatgtcatcaggaatctcgacctcaccagcggtcgccgtcgcaggatcaaccgaactagtaatcatccgagacagcgccacaccgaactgctgggtgcgagccaacggagtagccaacgtcgtcgtatcgcctgcgaacttcgccaccggggccgccaagaaacccaacgccagcgccgcagcaatcgccgcacgcgcacccgtagcccacgccccagccgtacgtcccctcatcatcttgacgaccacgcccacaccggcgcacgtcgtcagcaacgtcaacaccgttccaccccagctgtccgctcccagcggggccaaaaccttgtcgtggatatcgttctgcaaccccaccagcgggccggtaatccacccgacccagctcatcgccacggtccagtccaacaaccggcacagcaacgcaatgaccatcaggtacgtgttccaacacataccaataatggaggcccacatagccttcaacggggccgtaacgccaccatcgtccatcgacatctggtactgaaacaagtgaataccgttggagtcagtcacattgaaaccgtcacccatccagcccagccccgggcccgacgccatagcaggcacactgctcagcgccaccaccaaaaccagcgtggtgacgatgatacggaaccaccgctccccggccccggggcggcgtggatgacggctcacgctgtctcccggtcgtgctcgggcgggttggagctggcggcttcgcggtggggagcgtaggcaggtctcagtagtcgaatttcaccgacgttgccgtgctgatcggcgtacaggccacaaccggggcctccggggttgagggcaatcttgaccaggtcagcgaactcttcaggggacgttttagggtccacgcccaggaactcgacacctttctgggcgaggttgatgttgtcgcacagcaacacgatgcgatgctgaatgaggttgcggacggtctcgttggggtaatcggcctcggggtcgtgggagccagtaatgagccaggcgttggctcggcgggattcgcgcacgtactcatcgatggcgtgggaggcttccggcgaggacgacatatggtggaactcgtcaacgatgaaagcggcgtcgcgggcccggtcgctgaagcacaccaggcgagccagacgggcaataagcgcgtagagggctcggccaaacaccttgtgcgggggcagctgccgaaacaaatgttctgacagcatctcctcggcgttaggaagagcgatgccacaagtgccaatgatgaggatgtcggcactcaggtcggcgggaggaaggtccgggtcaaagatggccgaagctagggaggccgagttctcgatgtcagcgaacacggcaatcctgtcagcgatcgcggtggcctcgggaaggtcgcactcctcggccaggtggcgggccaaacgcccacacgaggtgatctggtggtcacgcatgtaggccggtttgaggaccttggccagcgtggtcccggccacaccgatggtctccaagttaagcaaggtcagcaagaacgactgggcgacctgcccggccatctccgggggaaggatgcgcagcgggtccagcgacagcttggggtgggccgtgtcgacgatctggcgtctaaccccgtcgatagagttgacaaaggttacccactcccgctcatcggagttgtcggtggcaataatgcgcccgccccgggccgcgatggctgcgcacagccgcttctcggccatcgtcttgcccgcgcccatcttgccgatgaacgccaccgtgttgcctttctgatcctgagtgtcggcatgcaaatcgaggtaggccagcgactgcaacggggagcctgtgaccacagccaacgggatgccggtggtacggcccaaccggtactcaaccaccgggatagatgcggcgaacgcggaggcgtgagtcagctgacggtaggcgttaagcgaggaggagaaccggccaccgggccgggcagcccacagcaagtcctcctgacggcccacgggacgcacccacgtgaagtcaccgaacaccggatcattgacgaacgctcctgccagctcctcggtggtctcaaagtcaggagacgagacagtgacggtgataagagcctggatctcgacctcacgctcatcggcggccagctcggcgttgtagtcgacgagcacctgagcggaatgctcgatagacatgagggtcgaagcctgggtcatctcaccgccctcaacattgtcgagctgatcgacggtttggcggatggcccgctgatttttctgcatcgcagcgtgacgggtccgggccactccccggatcgccacgtcgaccggcacgccagtgtcgtcgatacggcccaagaactcgtaggcaggccacgtcatcgtgcggggcaccttacccagcacgatatgggactggtagacggtctcgccggtgtcggcaccgattttgaggacgcgacgattccacgcctgagccgtccgggacatgtgggagactcgcttgtcatcctcgctggccagcaggtcggaggtcgcggcctcatcgatgaccaactcccccagcgcggcacgtccaacctcatccatgagggcgattccctcgccaggggcatcatcacgcaaccgggtcgggtggcctgacaggtgctgccgaagccagatctgttcatcaacggtgaccgggcggggttggaacgctgccggcagtttcgcaccgaattccttagcctgacggagggcccactcccgtgcgacacggccaggagcggtggtcatgagtccggcgacttcggtgattttgttgagggcggcggtccaggcggtgtgggtgcgtattttctggtcttggttgagtttgatcgataggaaccacacgcgccggcctagggatgcggtttcaggctggtcgagggtggcgtcgatttcgtcggcccacacggggtgttcgctcaggtcgaggccggcggccatggcgtcgacgatttctgtggggtcggtccaggtgagggccccgttgaggcagaactcgtggcgggcgaggtggcggaataggtcgcggtgagctgcggcgacggtgagggaggcgttctcggtgacgggtcgctggaggggagtaagtcgccaagtggcccagatgtcgccggtggaggtccagacgaggttgtcgaagaggaaccgttcggggatggacatcatgactccttttcggcggcggcgaggaaggcttccaggccgctgcggcgtacagcgttcccagtagggtgcaggggttttctgggggtgggttcagatttcgaatgtgggaagagtttgtggatggtatcggtgtcctcggcgagggcttggtcgagcaggcaggtggccggggtgtcggtcatctcgtccagctcgtcgatcatctcgtcgaggaggttgggggtggtggatgcggcccacacaggtgggatagccggtgcgggtcgaggcggtgtggggaggcggagtttggtttggccccagaggggtgtgtgggtcatgccggcgggagtggtggcggcgtgagtggtcacacgccaccagcccgacagccatgccagaggtgaccaggtccagtcgatgcgaccaacaacgaactgggcgagccatccggcagccagcgcgaaaatgaaaccgcggatggtcatgcccccgtcgataattttgaagcccatcatcgcggcaggaactacaccgccgacagcgagcacctgatagatcgtgtagggcccgccaggaatccttcgacctgaggaatccttgccgataatgcggggctgctggcgggcctcggtgtgccactgaatatccacgatcagctcttgcccaatccttgcatcatctgtccgaagaattggatcgcgttaccttcgataagccagtgcgccataccacacacaaacagcatggagacgatcttggccaggctcataccgtgtttgaagatgttgaacgcggcaatgcccacgactacgaccatggcgacggctcgcaccgcggactgaccttcacctgccttgatcgtcgtccattcgaagaggttctgcgattccagtggcagcaggaggaattgatcgagcatgagaggttttcctttcaggaagccgaccgggatggtcccggtactgacgggctggacggcacgggtgtgccggccaggggcagaaggcgtgacggctggtcgagggcggcaacctcccagcgtcctgcacgactgacaagagtcaggccgtactggctagtccgggtagtggattcgtcaccggtgggctggcatgtcacggtcaccgtgacggtaatcttctgccgatctgagggggtggggacctcgtcaggccccaccacatgagtggttttcaccgatacacacggggctgggtcaaccgcggtgaaagcggtccccgggctactccatctcgacaggtcagtattcccggtcagcatggcggccaagaaacccgaagaggtctgggcagccgggtcagcaggacgaatctccgaggagtccacgtcgggggctgaggccggtgcaggcatggggatctgcccaggtagacgcaaggcgatggccttgccgccggcatcgacgtggaccggaaccgaccaggcctgtccgctcccggattggccgcccatggtgaccacggtgacctgccacaggctcggatcagacggggagacggtagcgtcataggcggtgacggtggtgggcgctggaccaggtttgcggggcatgcgcgcatcggtgatcttggccgccaccaggtgttccagattgtccaagtgcccggagtcagaggtcagcagaagagtagtcacctcgaccgcggtggctgaggcgatctgagctgtgcggcggtcgtgatgggtggtgtcagtgctgacagctgtggtgggagcggatgccggggccgccgaacggaccagggcaacggggccgcatgcgactccgcacagcacgagggcaaggaagcctttggtggccatcgatccggtgtggggccagggacccacgttttcctgtgcctgttttttcttggccgaccaacggcgggacttagggttagcggatgcaccttctggggtgcatgctcgtctcaatcgcatcggtcacctccttcactggatgaagggaccaaggaggtgaccgatgtgcggtcgaacccgaaaaagttcaaacttttttctgggtctgcctcaagtacgacagaaggcctgcatcatcacggcgttgtggtagcagatcttgcgtcagcgcaaatgcatgggcctcgtaggagtagctcttaggtaggtcccggtggttgcggccagggcgagggtgtcgggtatgtgtagcgctagtcccgggttcgtggtgtgagggcttttgggtgctgacatgcactacccattgctagacgctgtgctgtggcatggctggacgtctagcagacgggttgacatcacctttaggctggcagcgcccgaggccgcaggccagaggaagcggacagcctaacgattgacgtccccctctcctttccccaacctcctggagtcgatgacccggagatagatcgatgtctatgcatcggtgcatcgatatacctatgtatctgtctgtggtttttagaggccactcccgtcgccccgggccgctcagcgataccgcaaggctgtgtgggatcagct

SEQ ID NO: 205 - DNA, 2061 bp, Propionibacterium acnes
gcgagccacgaccatcgccaagctgaatggagagcgagcatgagcaccacccctgccgggttcgacttcgacgctctggccgagtgggccgagagcgatgaggcgacccacaccccgcaaaccagccctgtgttccggggcaaggacgccgcgcgcgccagccgcgcattcctcggccgaggacggcccaccctcggcgcggaccacgccaccggtgagggccggtcgccccgccgtcaggtacggctcgacgcacgcaccaacgcgcgactcgacgcctacgcagccgcaaccggcaccagcgcctcccagatcatccgcgacgccctcgctgactacctgcccgcctgatcccaccccaatccactcgggcgcctgtcagtgcccccctcttctgggtggtggtccggggcgtcaccgccccggaccagttgggtagtcatctcagttgaaataagcgattagtgatacgcccctcctgctttccggtgctgtcatgagcgtctgacaacagcgacacctcggggcagccgacggacagtcctctggctgccgctctgatcccatgcccacggcacgaaggtgtcggacagctcggtctcatcatgtgcccaaatagcgtcgtgggcctgtcgccaagcttctcgggagccccacacgggcacgaccgggccacaccggtgtcctggtctccagtgtcgcgacactgtcgatttcggtacgtgcaatgcggcggcggtttgacggatcgacatcccagactcccgcgcgtcccagatcgccatgtggagagtatttgcctccagtgcggccgccacacttgcacgctctcgcgcacgctcgaatgcccgcctagtgctctcaaatgtcgtcacgacgcctccccctgaaaatactcagggtgtcccacggtgggacaccctgagtatttcataccccaactcgcctcaccacacgtcgacctcgacaccgatcaagcgacccgtatcagcgacattgccgtaccgctgacccgcctggtcctctagccacgacaacgcatcccgaaacagcccgacgtcttccaaagctaaaccacagtcgtagccgcccttatcccccaaccgcaccatctggagctcccggtggcctccctcgtcgacctcgatccacagtttcgcgtgcatccgctggcctcggccctctgacaggatctcggtgagcagatcggacgcctgccctcgcgcatcctcgttactgcgggggaattggagtatgtgggaggaacgatgatgggggaggttggtgacctcatggcgcagcaggttgcgcttgtgcatctgctggtcgagacggtcgggctgacctgttgacggggttgtgccgtggcggcgtttcctcggcggggtctcgatccgttgctcttccggcggttcggcgtcaggttgtggtgcgcgatctcccctaggacgggggggctcgccacctatatccgagggacgatgagacggccttccacgcttgctgcgcactttcgcagcccgccccttgcggtcacgtcgacgcggcggcggagtgacgtcctcaccgcgcgctaactgtgttaacgcctcgaccaggttggtgcccggtttcagcccttttagcacgaaccgcaccaggcgggggtctcggccgattcgtcgggcaatctcggcttggctccacccttcggctaacagggtgcgcaacaagtcttgggcccggttatcacgctcagtcactggtcgcctcctcggggagtcctgcctgctcggcctgctctgatagagcagcccgttccgatccggtctgaggcgctttcaggggaccgggtaggacacctttgacacgcagtcgcccgtccttgccgtcatcgccgcccccctgggccacagggagcgcccaggggggcacgttgctggtgtagatggcgtcgccgtggatagccagcagggtgcgggagttcatgcgtagtgctcctcccttggttgtggcgttttttccggtggtggggtcggcgatgggtgtgttgagggtgcgtacgcgggacagggcccagat

SEQ ID NO: 206 - DNA, 12531 bp, Propionibacterium acnes
ccccaatgcccccacaacgatcagcacacccacggcgatcatcaggtgggcagcactaactgatcccaacggaccaagatcaaacaagccctgcccgggagcgccgagcagtccgtgggcgcgaagccatgctccgagattgccaatgatcttggggatcatcttgttcagtagggctatccctccgatgccgacaacgaggaagacgaggatttcttcgcctgcgttgtttcttcctgtgtttgcggtcatgctgccttctcggggtggatggccagccagctgatgaggttgtcggtgatctgccctgagatttggatcagttcgacttgcccggcctgccatgcccgcgatgtgccggccagcaatgatgctgggacccctactgcgcggccacgggatgcaacctcagccaaggcggcgcgtaactcctcgacggtgctttcgatgtaccaactgccgtcagtactagtctcagcggcatcggtggtagcgataagagcatcggtgaggtcgtcgacggcgcggtccagatcagcgatgtccggtagggctacaggagtcatggtgtgtcttccttctagggtgccttcactggtgaagggtccctagccccggccgatgtgcggttctgtgggaaaaatgcttcccattggtccgtcttagttaggaaacttggcctaagtgctgtcgagggtcgcgtgttcgtgaccggttcgaagacactgccgccttgccttcttgtcagtggcgtttccgagatggggtcagtgggcgatggctaggccgatgagggcgccgctgcacaggctgggtgcccaggggaggaatcgggtggtgtggtgtcggaaccggtcgatgagggcatatagggcgatcagggtgaggccggctatgacagtgacctggatcgtgtcgatgccggttgctgcggccggggctgcccacagtggtgtgatgcgcacgtcggagaagccgaagccgcctcgggagatgagccaggcgatcatccacgctgcgaagatgatggcggtagcgatgacagcacgtgttgccgcagtatggtccgagagggcggtaacgactacagccccgatccatccggcccatccggtccacgctaggactgccggtatccatgtggtgatggcgtcaatgacggcaacccatgccccgatggtggctagcagggcccacgtcggccacgtgggtgctggggcccatgctgtggcggtgatcatggtgagtgctgctgcgctacagaccgcgatcaagcttcggaggctgtaggtgtcgcggtaggcgatcttgtcggggctggcggtgggtggttcgggcaggatgtgggtgagggcaggccaccctgcgaccgcaatagccgcgacggcgaccacccacacaatctgttgcatgggtctcatcatggcccatcaacgatgagtatgggtggccgacatgggctcagtcgtcaagaggtgtacgggcggttgtggcttcttgggtgctgagcatgagggtgccagaatcctcgccagccgattcccagtcgacgatgacctggtcgccgtcaacgctggattcggcgatggtcacccattgcccgtccatgtcgatgagcatcccggcggccagctctgtggcggcaaccgggtgggctgggctgtagaagcggtcgatgtcgcgggcagggtcgtcgggttcttcggttacctcgggtggggtcgatctggctgtctcggtgtcgtcggccaggtcggctcccaggatgcgttcccattcggggctggttttcttgcccgctgaggccatcgtctcgtcgatctgttcgtcagtgggccacacaaatttctttttggtccaggtcgtggtgtcgggtcgcagctgatccagcagttccaggtcttgcggggagtgggccttgcgggggtcgggggtgtagaagaattggacttccttgggggctgattcgccggataggtaggtgccgcggccgcgtttgccgaacgggattcccacgccgacgtgttcggagccgaacatcatgcgggctccgtcagcggacaggggtccggtggcggcacgcccggagaagttgtctcggatttcgccgcccaggaactcggcgtcggggcgttgggtccccagatcgacgtggatacggcaggcggctgccatgcgcagcagggagccgatccagccgaaaacggggcattctccaggcatcccagagaccttgatcgttgaccaccagtttttcgcgttgccgtagaactggcggtactcgtcgatgaggaccagcacgcgggtgaagtcggtctcgcgggccccttcttcttcgatgcggcggtagcggtcctccatgagagaccacagccagtggatgagggcgacctggtcggggacggtagtggcgaccatctcgatgttgggccactcccgcaggcccaggtactcgatgcgtttagggtcgatgacgaagacgcgccagttgcggcgggcaccctcgacggcgtcgccgatcatggacaccgtttttccggtacgggtgcggccggccttgagctggtgggccatgacaccggagatgtcccagaaacaggtgttgccgtcctcgtcgacggcctgggggattttctcccagtctggggagtctgggcccggaagggccacgggtcggggcaccatcgagggcagggggtggcggcgggtgacggtgatggtgtcgtgttccaggtcgaagtcgctgcgccactggccgagcatcatcgccgaggtcaccgcggccaggcgcaattggatgttcgggctggacaaatgggcgccacgttggtggtgaatggtgaagccgtccaggttcccccgatcggttttccaggaatcgacggtgaccgccgacccatagatctgagtggctacttctttagcccgttccttgtctcggtccagatcggttttgtcagggtcaggggtcggggcgcggtattgcaggacgaaccggccggccgggatcgttgcggatgtcaccgtgaactctgccggcgaccaggcagccgcggccgcctgggtgagggccattggcatggtctcgacggcagcctcctcgggggggatggtgagggtcaggcgtcgcggatgggtcttcttgcgattccatgtgactttctgcctcaccggcaccttcgccgccgactgaatggctaggcgagctgattcggcagtttcggtacgccggccagcgcgtagcgcccgtcgtgcgtgaaggctgcccaccacagcacagcccatacacggcagccaccagcgcggatcagcggctgctgcatagcccccggtagctagtaccgcacctgaccagccggccgcgatacttttccacgccggtttcgcgccaccaggaccagcgttatggacggtctgcttcgaggctgcggagggacgagacagcggagtgctggtcatgccgcggcctccttgtggcaggtcatttcacaggcatgtcggccagcgatgatgccgtggcgcaccgccccggtagccgcatagaccgcgcacaactcaaacacggggcacccatcgcaggccgccgggtccatgctttctttgtcccacgatggtgggtcatcggtgcacggcacggccaggccgtcctgctgggcggtggcgatagcggtgaataagcgcagctgggcgcgaacttggtctggggtcaggttgacagtgcgggctacacgcatggggttccttcctcttcaccagtgaaggttccttagccccgagcgatgtgcggagagatttcagtgttttatcgaggtgaccagccatccggtctgcgctgcgggttcaggtaccagggtcagatgcaccacggtgtggtcggctaggggcacggcgaccaggggcccgtcggcgctcgccccggtgagggtgggagttccggccacggtggtggcgggaatctggttgggtttcgcggccatcagggagcccatgagggtcggggcggcgatctggacgagggcgactttgcgggcggcgggatcgcgggtcaaccagccgcgggtgaaggtgagcgcagccgacgtgatatcggggctcagcggggctggtgtggcggcggggtgggccgttgaggagggccatacgcgcggtagcgctggcgacatcgagcgggtcggagtggggtcaggtgtggggcttagggtccgatgtggcgatggggctaccgccccggtggtgggagacgagactggttgggggtggtgttgagggcgtgggatcagggtgaaggcagccaaactggccgggatgaggatgacggccgcgccgacacttcggagcgaggtcatgtgacgatccttcggtagctcgacgggttgccgtagatcttttccacgttgatgccactatgtgggttgtcggcgctgaccatttggcctccaccgatgtagacggccacgtggtgggcaggggtcccccaaaagatgaggtcgccgactttgagctggtcgtgggccacggcagtgccgactttctgctggtcggcggcggttcggggaaggctgatgccgatacgccggtacagcgccgaggtcaggcctgagcagtcgtagccgccatcagctttgccgttaccaccccacacgtaggcgtaggagttgttgtcggcgatcgatttggcccatgccacggcttcggccaggttcttcgacacaccggtctcgttagcggccccgatggcacagttgtttgacaggtgccctgtagtagtggatcccactatttgtttggccatggtttcccatttggcgtaggcatcgggcagggctgagccttgcactgcctgagctgcctgcgtcagcggcatcttctgccagtcagcgatgtcgactaaaccgggaatgtggaatccagggccgccggccgatccggggccagcgtaggtgatggtgtggcctttcaagaacgcctcggtggcgtaggcatcattgttgacctgatccagagtcccgtaccagcccggcaggatgcgctgctgaaaggggccggcgtcaccgtcaccgttagccttcgctgaggtagggtcggccccaagatctgattcttgtttggcggtcatgatagcgatgaccgctgcctgggtaggcagtttgtcacgctggaccacagtgacgatggtggtcacgagctgcttctgcctggccgtgaggcctccggcacccacagtgcctccggtgacggtacccacgcaagcatccccgccgacactgccaccgccgccgccagagttgtcgtcgagggccccagagcctactgacagcagcggcacaatgatcacggtcgctggcaagaccgccaggcccgccagcatcagcactgctgcactcaccacggcgatcacgtgagatgctttcaacgctgcccacctctcgctggtttgagggggcgacgcctgctggtacgcacaggcttggttgatccagtccgccgttgattggcaggcctgggtttgatcggcttgctgggacccggtttgggctccggagtcttaggctccggcttcacatgcctaggcacttcggctgcggtgggaggagtcagcacgtggcgtaccggcttggtgaccttctgggcacccgaaacaaccggcttagacaccaccttggcacctttgaccaccggtgcggctgccttcgcgccggccttcttgactgcacgatgcgctttgatagccccggcctcggcccggccaaccctactagcagtagcatcgagggctctgtggcccgtcgttgccctcaccggtgcatccttgccctggcgggtctgcttcgcgatcgccgacatgccgcctcgcaatgccgaaacatgattgtgggcgtgggcgatcgccgacatgccggccgtcgcgatttttgactggccctgcggggcccctgccccagcacgaatctgccggtaagccgccgacgtgccacgagcacccgccgccattcgcgccaccttcgcagccctagtcactcccgtcgacacgccacccgtggctaccgcagcagcacccgagaccacagtcgaggccatccgccttcgacccgatccggtgagcttgcgaccaccactgcgcaccatccggcgagcaccccgcccagcccactggccgatcaccgagcccctttcggaacgcttgctgcgcatccaatcgttgatcttgtccctcagccccttctcgcccttgtgacgacgccacatggacatcaagaacccgataatccccacgagctcgagcatgttgacaaccatgaccttgatggcgacatcaccgtcagaggcgaaaaccgacttgatgatgagcatgaccacacccaacatcaccatcgacccgacaatgccgatcatcgagtacaagatcgaacacagatcccggatgagcggatctgtgcggccagggatagcccgcaacacgttgagcatcgacataaacgccgaccacaccaacttgcacacgtagaaccagcacatgcccgcgaacaccagcaggaccacagccaaacccgccaccgtcgacgagtaaaagaagaaacccaccaaccacgaaccatccgcaatatcgccggcgtaatccgacaacccctcatcacagtcaccaaggtcgtcgcgagcatccgagacgtcatcgtaagggccacccttgagcacctcgatgtacttgtcgtggcacttcgcatcaataatccggccatagttgagctgctgatgaaccggcgccacgaacgagtccacaatgatcgccgacagcttcggatccttcgagtctcccgtcgaggtcatgtcatcaggaatctcgacctcaccagcggtcgccgtcgcaggatcaaccgaactagtaatcatccgagacagcgccacaccgaactgctgggtgcgagccaacggagtagccaacgtcgtcgtatcgcctgcgaacttcgccaccggggccgccaagaaacccaacgccagcgccgcagcaatcgccgcacgcgcacccgtagcccacgccccagccgtacgtcccctcatcatcttgacgaccacgcccacaccggcgcacgtcgtcagcaacgtcaacaccgttccaccccagctgtccgctcccagcggggccaaaaccttgtcgtggatgtcgttctgcaaccccaccagcgggccggtaatccacccgacccagctcatcgccacggtccagtccaacaaccggcacaacagggcaacgaccatcaggtacgtgttccaacacatgccaataatggaggcccacatactcttcagcggggccgtaacgccaccatcgtccatcgacatctggtactgaaacaagtgaataccgttggagtcagtcacattgaaaccgtcacccatccagcccagcccaggacccgacgccatggcaggcacactgctcagcgccaccaccagaaccagcgtggtgacgatgatacgaaatcgccgctccccggccccggggcggcgtggatgacggctcacgctgtctcccggtcgtgctcgggcgggttggagctggcggcttcgcggtggggaccgtaggcaggtctcagtagtcgaatttcaccgacgttgccgtgttggtcggcgtacaggccacaaccggggcctccggggttgagggcaatcttgaccaggtcagcgaactcttcaggggacgttttagggtccacgcccaggaactcgacacctttctgggcgaggttgatgttgtcgcacagcaacacgatgcgatgctgaatgaggttgcggacggtctcgttggggtaatcggcctcggggtcgtgggagccggtgataagccaggcgttggctcggcgggattcgcgcacgtactcgtcaatggcgtgggaggcttccggcgaggacgacatatggtggaactcgtcaacgatgaaagcggcgtcgcgggcccggtcgctgaagcacaccaggcgagccagacgggcaataagcgcgtagagggctcggccaaacaccttgtgcgggggcagctgccgaaacaaatgttctgacagcatctcctcggcgttaggaagagcgatgccacaagtgccaatgatgaggatgtcggcactcaggtcggcgggaggaaggtccgggtcaaagatggccgaagctagggaggccgagttctcgatgtcagcgaacacggcaatcctgtcagcgatcgcggtggcctcgggaaggtcgcactcctcggccaggtggcgggccaaacgcccacacgaggtgatctggtggtcacgcatgtaggccggtttgaggaccttggccagcgtggtcccggccacaccgatggtctccaagttaagcaaggtcagcaagaacgactgggcgacctgcccggccatctccgggggaaggatgcgcagcgggtccagcgacagcttggggtgggccgtgtcgacgatctggcgtctaaccccgtcgatagagttgacaaaggttacccactcccgctcatcggagttgtcggtggcaataatgcgcccgccccgggccgcgatggctgcgcacagccgcttctcggccatcgtcttgcccgcgcccatcttgccgatgaacgccaccgtgttgcctttctgatcctgagtgtcggcatgcaaatcgaggtaggccagcgactgcaacggggagcctgtgaccacagccaacgggatgccggtggtacggcccaaccggtactcaaccaccgggatagatgcggcgaacgcggaggcgtgagtcagctgacggtaggcgttaagcgaggaggagaaccggccaccgggccgggcagcccacagcaagtcctcctgacggcccacgggacgcacccacgtgaagtcaccgaacaccggatcattgacgaacgctcctgccagctcctcggtggtctcaaagtcaggagacgagacagtgacggtgataagagcctggatctcgacctcacgctcatcggcggccagctcggcgttgtagtcgacgagcacctgagcggaatgctcgatagacatgagggtcgaagcctgggtcatctcaccgccctcaacattgtcgagctgatcgacggtttggcggatggcccgctgatttttctgcatcgcagcgtgacgggtccgggccactccccggatcgccacgtcgaccggcacgccagtgtcgtcgatacggcccaggaactcgtaggcaggccacgtcatcgtgcggggcaccttacccagcacgatatgggactggtagacggtctcgccggtgtcggcaccgattttgaggacgcgacgattccacgcctgagccgtccgggacatgtgggagactcgcttgtcatcctcgctggccagcaggtcggaggtcgcggcctcatcgatgaccaactcccccagcgcggcacgtccaacctcatccatgagggcgattccctcgccaggggcatcatcacgcaaccgggtcgggtggcctgacaggtgctgccgaagccagatctgttcatcaacggtgaccgggcggggttggaacgctgccggcagtttcgcaccgaattccttagcctgacggagggcccactcccgtgcgacacggccaggagcggtggtcatgagtccggcggcttcggtgattttgttgagggcggcggtccaggcggtgtgggtgcgtattttctggtcttggttgagtttgatcgataggaaccacacgcgccggcctagggatgcggtttcaggctggtcgagggtggcgtcgatttcgtcggcccacacggggtgttcgctcaggtcgaggccggcggccatggcgtcgacgatttctgtggggtcggtccaggtgagggccccgttgaggcagaactcgtggcgggcgaggtggcggaataggtcgcggtgagctgcggcgacggtgagggaggcgttctcggtgacgggtcgctggaggggagtaagtcgccaagtggcccagatgtcgccggtggaggtccagacgaggttgtcgaagaggaaccgttcggggatggacatcatgactccttttcggcggcggcgaggaaggcttccaggccgctgcggcgtacagcgttcccggtagggtgcaggggttttctgggggtgggttcagatttcgaatgtgggaagagtttgtggatggtatcggtgtcctcggcgagggcttggtcgagcaggcaggtggccggggtgtcggtcatctcgtccagctcgtcgatcatctcgtcgaggaggttgggggtggtggatgcggcccacacaggtgggatagccggtgcgggtcgaggcggtgtggggaggcggagtttggtttggccccagaggggtgtgtgggtcatgccggcgggagtggtggcggcgtgagtggtcacacgccaccagcccgacagccatgccagaggtgaccaggtccagtcgatgcgaccaacaacgaactgggcgagccatccggcagccagcgcgaaaatgaaaccgcggatggtcatgcccccgtcgataattttgaagcccatcatcgcggcaggaactacgccgccgacagcgagcacctgatagatcgtgtagggcccgccaggaatccttcgacctgaggaatccttgccgataatgcggggctgctggcgggcctcggtgtgccactgaatatccacgatcagctcttgcccaatccttgcatcatctgtccgaagaattggatcgcgttaccttcgataagccagtgcgccataccacacacaaacagcatggagacgatcttggccaggctcataccgtgtttgaagatgttgaacgcggcaatgcccacgactacgaccatggcgacggctcgcaccgcggactgaccttcacctgccttgatcgtcgtccattcgaagaggttctgcgattccagtggcagcaggaggaattgatcgagcatgagaggttttcctttcaggaagccgaccgggatggtcccggtactgacgggctggacggcacgggtgtgccggccaggggcagaaggcgtgacggctggtcgagggcggcaacctcccagcggcctgcacgactgacaagagtcaggccgtactggctagtccgggtagtggattcgtcaccggtgggctggcatgtcacggtcaccgtgacggtaatcttctgccgatctgagggggtggggacctcgtcaggccccaccacatgagtggttttcaccgatacacacggggctgggtcaaccgcggtgaaagcggtccccgggctactccatctcgacaggtcagtattcccggtcagcatggcggccaagaaacccgaagaggtctgggcagccgggtcagcaggacgaatctccgaggagtccacgtcgggggctgaggccggtgcaggcatggggatctgcccaggtagacgcaaggcgatggccttgccgccggcatcgacgtggaccggaaccgaccaggcctgtccgctcccggattggccgcccatggtgaccacggtgacctgccacaggctcggatcagacggggagacggtagcgtcataggcggtgacggtggtgggcgctggaccaggtttgcggggcatgcgcgcatcggtgatcttggccgccaccaggtgttccagattgtccaagtgcccggagtcagaggtcagcagaagagtagtcacctcgaccgcggtggctgaggcgatctgagctgtgcggcggtcgtgatgggtggtgtcagtgctgacagctgtggtgggagcggatgccggggccgccgaacggaccagggcaacggggccgcatgcgactccgcacagcacgagggcaaggaagcctttggtggccatcgatccggtgtggggccagggacccacgttttcctgtgcctgttttttcttggccgaccaacggcgggacttagggttagcggatgcaccttctggggtgcatgctcgtctcaatcgcatcggtcacctccttcactggatgaagggaccaaggaggtgaccgatgtgcggtcgaacccgaaaaagttcaaacttttttctgggtctgcctcaagtacgacagaaggcctgcatcatcacggcgttgtggtagcagatcttgcgtcagcgcaaatgcatgggcctcgtaggagtagctcttaggtaggtcccggtggttgcggccagggcgagggtgtcgggtatgtgtagcgctagtcccgggttcgtggtgtgagggcttttgggtgctgacatgcactacccattgctagacgctgtgctgtggcatggctggacgtctagcagacgggttgacatcacctttaggctggcagcgcccgaggccgcaggccagaggaagcggacagcctaacgattgacgtccccctctcctttccccaacctcctggagtcgatgccccggagatagatcgatgtctatgcatcggtgcatcgatatacctatgtatctgtctgtggtttttagaggccactcccgtcgccccgggccgctcagcgataccgcaaggctgtgtgggatcag

SEQ ID NO: 207 - DNA, 12036 bp, Propionibacterium acnes
ccccaatgcccccacaacgatcagcacaccaacagcgatcatcaggtgggcagcactaactgatcccaacgaaccaagatcaaacaagccctgcccgggagcgtcgagcagtccgtgggcgcgaagccatgctccgagattgccaatgatcttggggatcatcttgttcagtagggctatccctccgatgccgacaacgaggaagacgaggatttcttcgcctgcgttgtttcttcctgtgtttgcggtcatgctgccttctcggggtggatggccagccagctgatgaggttgtcggtgatctgccctgagatttggatcagttcgacttgcccggcctgccatgcccgcgatgtgccggccagcaatgatgctgggacccctactgcgcggccacgggatgcaacctcagccaaggcggcgcgtaactcctcgacggtgctttcgatgtaccaactgccgtcagtactagtctcagcggcatcggtggtagcgataagagcatcggtgaggtcgtcgacggcgcggtccagatcagcgatgtccggtagggctacagcagtcatggtgtgtcttccttctagggtgccttcactggtgaagggtccctagccccggccgatgtgcggtgctgtgggaaaaatgcttcccattggtccgtcttagttaggaaacttggcctaagtgctgtcgagggtcgcgtgttcgtgaccggttcgaagacactgccgctttgccttcttgtcagtggcgtttccgagatggggtcagtgggcgatggctaggccgatgagggcgccgctgcacaggctgggtgcccaggggaggaatcgggtggtgtggtgtcggaaccggtcgattagggcatatagggcgatcagggtgaggccggctatgaccgtggcgtggatcgtgtcgatgccggttgctgcggccggggctgcccacagtggtgtgatgcgcacgtcggagaagccgaagccgcctcgggagatgagccaggcgatcatccacgctgcgaagatgatggcggtagcgatgacagcacgtatcgccgcagtatggtccgagagggcggtaacgactacagccccgatccatccggcccatccggtccacgctaggactgccggtatccatgtggtgatggcgtcaatgacggcaacccatgccccgatggtggctagcagggcccacgtcggccacgtgggtgctggggcccatgctgtggcggcgatcatggtgaccgcagccgcggcacagaccgcgatcaagcttcggagactgtaggtgtcgcggtaggcgatcttgtcgggattggcggtggccggttcgggcaggatgcgagtgagggagggccatcctgcggtcgcaatagccgcgacggcgaccacccacacgatctgttgcatgggtctcatcatggcccatcatcgatgagtatgggtggccgacatggggtcactcgtagaggggatcgaggggtgtgcgggcgagcatggcttcctgtgtgccgagcatgagggtgccagagtcgtcgccggccgattcccagtcgacgatgatctgcccgctgtcgacgctggattcggtgatggtcacccattctccgtcgatattgatgagcaccccagcggccagctctgtggcagcaaccgggtgaggtgggttgtagaagcggtcgatgtcgcaggcagggtcgtcgggttcctcgactaccggaggtggggtagggctgagctgttcggtgtcgtcggccaggtcggctcccaggatgcgctcccattcggggctggttttcttgcccgctgaggccatcgtctcgtcgatctgttcgtcagtgggccacacaaatttctttttggtccaggtcgtggtgtcgggtcgcagctgatccagcagttccaggtcttgcggggagtgggccttgcgggggtcgggggtgtagaagaattggacttccttgggggctgattcgccggataggtaggtgcctcggccgcgtttgccgaacgggatgcccacgccgacgtgttcggagccgaacatcatgcgggctccgtcagcggacaggggtccggtggcggcacgcccggagaagttgtctcggatttcgccgcccaggaactcggcgtcggggcgttgggtccccagatcgacgtggatacggcaggcggctgccatgcgcagcagggagccgatccagccgaaaacggggcattctccgggcatcccagagaccttgatcgttgaccaccagtttttcgcgttgccgtagaactggcggtactcgtcgatgaggaccagcacgcgggtgaagtcggtctcgcgggccccttcttcttcgatgcggcggtagcggtcctccatgagagaccacagccagtggatgagggcgacctggtcggggacggtagtggcgaccatctcgatgttgggccactcccgcaggcccaggtactcgatgcgtttagggtcgatgacgaagacgcgccagttgcggcgggcaccctcgacggcgtcgccgatcatggacaccgtttttccggtacgggtgcggccggccttgagctggtgggccatgacaccggagatgtcccagaaacaggtgttgccgtcctcgtcgacggcctgggggattttctcccagtctggggagtctgggcccggaagggccacgggtcggggcaccatcgagggcagggggtggcggcgggtgacggtgatggtgtcgtgttccaggtcgaagtcgctgcgccactggccgagcatcatcgccgaggtcaccgcggccaggcgcaattggatgttcgggctggacaaatgggcgccacgttggtggtgaatggtgaagccgtccaggttcccccgatcggttttccaggaatcgacggtgaccgccgacccatagatctgagtggctacttctttagcccgttccttgtctcggtccagatcggttttgtcagggtcaggggtcggggcgcggtattgcaggacgaaccggccggccgggatcgttgcggatgtcaccgtgaactctgccggcgaccaggcagccgcggccgcctgggtgagggccattggcatggtctcgacggcagcctcctcgggggggatggtgagggtcaggcgtcgcggatgcgtcttcttgcgattccatgtgactttctgcctcaccggcaccttcgccgccgactgaatggctaggcgagctgattcggcagtttcggtacgccggccagcgcgtagcgcccgtcgtgcgtgaaggctgcccaccacagcacagcccatacacggcagccaccagcgcggatcagcggctgctgcatagcccccggtagctagtaccgcacctgaccagccggccgcgatacttttccacgccggtttcgcgccaccaggaccagcgttatggacggtctgcttcgaggctgcggagggacgagacagcggagtgctggtcatgccgcggcctccttgtggcaggtcatttcacaggcatgccggccagcgatgatgccgtggcgcaccgccccggtagccgcatagaccgcgcacaactcaaacacggggcacccatcgcaggccgccgggttcatgctttctttgtcccacgatggtgggtcatcggtgcacggcacggccaggccatcctgttgagcggcgctgatagcggtgaataggcgcagctgggcgcgaacttggtctggggtcaggttgacggtgcgggctacacgcatggggttccttcctcttcaccagtgaaggttccctagacccggccgatgtgcggagggatttcagtgttttatcgaggtgaccagccagccggtctgcgctgcgggttcaggtaccagggtcagatgcagcatggtgtggtcggctaggggcacggcgaccaggggcccgtcggcgctcgccccggtgagggtgggagttccggccacggtggtggcgggaatctggttgggtttcgcggccatcagggagcccatgagggtcggggcggcgatctggacgagggcgactttgcgggcggcgggatcgcgggtcaaccagccgcgggtgaaggtgagcgcagccgacgtgatatcggggctcagcggggctggtgtggcggcggggtgggccgttgaggagggccatacgcgcggtagcgctggcgacatcgagcgggtcggagtggagtcaggtgtggggcttagggtccgatgtggcgatggggctaccgccccggtggtgggagacgagactggttgggggtggtgttgagggcgtgggatcagggtgaaggcagccaaactggccgggatgaggatgacggccgcgccgacacttcggagcgaggtcatgtgacgatccttcggtagctcgacgggttgccgtagatcttttccacgttgatgccactatgtgggttgtcggcgctaaccatttggcctccaccgatgtagacggccacgtggtgggcagggcttccccagaggatgaggtcgccgactttgagctggtcacgggccaccgcggtgccgactttctgctggtcggcggcggtgcggggaaggctaatgccgatacgccggtacagcgccgaggtcaggcctgagcagtcgtagccgccatcggctttgccgttgccaccccacacgtaggcgtaggagttgttgtcagcgatcgatttggcccatgccacggcttcggccaggttcttcgacacaccggtctcgttagcggccccggtggcacagttgtttgacaggtgccctgtagtagtggatcccactatttgtttggccatggtttcccatttggcgtaggcatcgggcagggctgagccttgcactgcctgagctgcctgcgtcagcggcatcttctgccagtcagcgatgtcgactaaaccgggaatgtggaatccagggccgccggccgatccggggccagcgtaggtgatggtgtggcctttcaagaacgcctcggtggcgtaggcatcattgttgacctgatccagagtcccgtaccagcccggcaggatgcgctgctgaaaggggccggcgtcaccgtcaccgttagccttcgctgaggtagggtcggccccaagatctgattcttgtttggcggtcatgatagcgatgaccgctgcctgggtaggcagtttgtcacgctggaccacagtgacgatggtggtcacgagctgcttctgcctggccgtgaggcctccggcacccacagtgcctccggtgacggtacccacgcaagcatccccgccgacactgccaccgccgccgccagagttgtcgtcgagggccccagagcctactgacagcagcggcacaatgatcacggtcgctggcaagaccgccaggcccgccagcatcagcactgctgcactcaccacggcgatcacgtgagatgctttcaacgctgcccacctctcgctggtttgagggggcgacgcctgctggtacgcacaggcttggttggtccagtccgccgttggttggcaggcctgggtttgatcggcttgctgggacccggtttgggctccggagtcttaggctccggcttcacatgcctaggcacttcggctgcggtgggaggagtcagcacgtggcgtactggcttggtgaccttctgggcacccgaaacaaccggcttagacaccaccttggcacctttgaccaccggtgcggctgccttcgcgccggccttcttgactgcacgatgcgctttgatagccccggcctcggcccggccaaccctgctagcagtagcatcgagggctctgtggcccgtcgttgccctcaccggtgcatccttgccctggcgggtctgcttagcgatcgccgacatgccgcctcgcaatgccgaaacatgattgtgggcgtgggcgatcgccgacatgccggccgtcgcgatttttgactggccctgcggggcccctgccccagcacgaatctgctggtaagccgccgacgtgccacgagcacccgccgccattcgcgccaccttcgcagccctagtcactcccgtcgacacgccacccgtggctaccgcagcagcacccgagaccacagtcgaggccatccgccttcgacccaatccggtgagcttgcgaccaccgctgcgcaccatccggcgagcaccccgcccagccaactggccgatcaccgagcccctttcggaacgcttgctgcgcatccaatcgttgatcttgtccctcagccccttctcgcccttgtgacgacgccacatggatatcaagaacccgataatccccacgagctcgagcatgttgacaaccatgaccttgatggcgacatcaccgtcagaggcgaaaaccgacttgatgatgagcatgaccacacccaacatcaccatcgacccgacaatgccgatcatcgagtacaagatcgaacacagatcccggatgagcggatctgtgcggccagggatagcccgcaacacgttgagcatcgacatgaacgccgaccacaccaacttgcacacgtagaaccagcacatgcccgcgaacaccagcaggaccacagccaaacccgccaccgtcgacgagtaaaagaagaaacccaccaaccacgaaccatccgcaatatcgccggcgtaatccgacagcccctcatcacagtcaccaaggtcgtcgcgagcatccgagacgtcatcgtaagggccacccttgagcacctcgatgtacttgtcgtggcacttcgcatcaataatccggccatagttgagctgctgatgaaccggcgccacgaacgagtccacaatgatcgccgacagcttcggatccttcgagtctcccgtcgaggtcatgtcatcaggaatctcgacctcaccagcggtcgccgtcgcaggatcaaccgaactggtaatcatccgagacagcgccacaccgaactgctgggtgcgagccagcggagtagccaacgtcgtcgtatcgcctgcgaacttcgccaccggggccgccaagaaacccaacgccagcgccgcagcaatcgccgcacgcgcacccgtagcccacgcccctgccgtacgtcccctcatcatcttgacgaccacgcccacaccggcgcacgtcgtcagcaacgtcagcaccgttccaccccagctgtccgctcccagcggggccaaaaccttgtcgtggatgtcgttctgtaaccccaccagcgggccggtaatccacccgacccagctcatcgccacggtccagtccaacaaccggcacagcaacgcaatgaccatcaggtacgtgttccaacacatgccaataatggaggcccacacacccttcagcggggccgtaacgccaccatcgtccatcgacatctggtactgaaacaagtgaataccgttggagtcagtcacattgaaaccgtcacccatccagcccagccccgggcccgacgccatagcaggcacactgctcagcgccaccaccaaaaccagcgtggtgacgatgatacgaaatcgccgctccccggccccggggcggcgtggatgacggctcacgctgtctcctggtcgtgctcgggcgggttggagctggcggcttcgcggtggggagcgtaggcaggtctcagtagtcgaatttcaccgacgttgccgtgctggtcggcgtacaggccacaaccgggacctccggggttgagggcaatcttgaccaggtcagcgaactcttcaggggacgtcttgggatctacgcccaggaactcaacgcccttttgggcgaggttgatgttgtcgcacagcaacacgatgcgatgctgaatgaggttgcggacggtctcgttggggtaatcggcctcggggtcgtgggagccggtgataagccaggcattggctcggcgggattcgcgcacgtactcgtcaatggcgtgggaggcttccggcgaggacgacatgtgatgaaactcgtcaacaatgaaagcggcgtcgcgggcccggtcgctgaagcacaccaggcgagccagacgggcaataagcgcgtagagggctcggccaaacaccttgtgcgggggcagctgccgaaacaaatgttctgacagcatctcctcggcgttaggaagagcgatgccacaagtgccaatgatgaggatgtcggcactcaggtcggcgggaggaaggtccgggtcaaagatggccgaagctagggaggccgagttctcgatgtcagcgaacacggcaatcctgtcagcgatcgcggtggcctcgggaaggtcgcactcctcggccaggtggcgggccaaacgcccacacgaggtgatctggtggtcacgcatgtaggccggtttgaggaccttggccagcgtggtcccggccacaccgatggtctccaagttaagcaaggtcagcaagaacgactgggcgacctgcccggccatctccgggggaaggatgcgcagcgggtccagcgacagcttggggtgggccgtgtcgacgatctggcgtctaaccccgtcgatagagttgacaaaggttacccactcccgctcatcggagttgtcggtggcaataatgcgcccgccccgggccgcgatggctgcgcacagccgcttctcggccatcgtcttgcccgcgcccatcttgccgatgaacgccaccgtgttgcctttctgatcctgagtgtcggcatgcaaatcgaggtaggccagcgactgcaacggggagcctgtgaccacagccaacgggatgccggtggtacggcccaaccggtactcaaccaccgggatagatgcggcgaacgcggaggcgtgagtcagctgacggtaggcgttaagtgaggaggagaaccggccaccgggccgggcagcccacagcaagtcctcctgacggcccacgggacgcacccacgtgaagtcaccgaacaccggatcattgacgaacgctcctgccagctcctcggtggtctcaaagtcaggagacgagacagtgacggtgataagagcctggatctcgacctcacgctcatcggcggccagctcggcgttgtagtcgacgagcacctgagcggaatgctcgatagacatgagggtcgatgcctgggtcatctcaccgccctcgacgttgtcgagctggtcgacggtttggcggatggcccgctgatttttctgcatcgcagcgtgacgggtccgggccactccccggatcgccacgtcgaccggcacgccagtgtcgtcgatacggcccaggaactcgtaggcaggccacgtcatcgtgcggggcaccttacccagcacgatatgggactggtagacggtctcgccggtgtcggcaccgattttgaggacgcgacgattccacgcctgagccgtccgggacatgtgggagactcgcttgtcatcctcgctggccagcaggtcggaggtcgcggcctcatcgatgaccaactcccccagcgcggcacgtccaacctcatccatgagggcgattccctcgccaggggcatcatcacgcaaccgggtcgggtggcctgacaggtgctgccgaagccagatctgttcatcaacggtgaccgggcggggttggaacgctgccggcagtttcgcaccgaattccttagcctgacggagggcccactcccgtgcgacacggccaggagcggtggtcatgagtccggcggcttcggtgattttgttgagggcagcggtccaggcggtgtgggtgcgtattttctggtcttggttgagtttgatcgataggaaccacacgcgccggcctagggattcggtttcaggctggtcgagggtggcgtcgatttcgtcggcccacacggggtgttcgctcaggtcgaggccggcggccatggcgtcgacgatttctgtggggtcggtccaggtgagggctccgttgaggcagaactcgtggcgggcgaggtggcggaataggtcgcggtgagctgcggcgacggtgagggaggcgttctcggtgacgggtcgctggaggggagtgagtcgccaagtggcccagatgtcgccggtggaggtccagacgaggttgtcgaagaggaaccgttcggggatggacatcatgactccttttcggcggcggcgaggaaggcttccaggccgctgcggcgtacagcgttcccggtagggtgcaggggttttctgggggtgggttcaggtttcgggtctaggaggggtttgggctcgtaggtggtgtcgatgtcttcggcgagggcttggtcgagcaggcaggtggccggggtgtcggtagtctcgtccagctcgtcgatcatctcgtcgaggaggttgggggtggtggatgcggcccacacaggtgggatagccggtgcgggtcgaggcggtgtggggaggcggagtttggtttggccccagaggggtgtgtgggtcatgccggcgggagtggtggcggcgtgagtggtcacgcgccaccagcccgccagccatgccagaggtgaccaggtccagtcgatgcggccgatgatgaactgggcgagccatccggcagccagcgcgaaaatgaaaccgcggatggtcatgcccccgtcgataattttgaagcccatcatcgcggcaggaactacgccgccgacagcgagcacctgatagatcgtgtagggcccgccaggaatccttcgacctgaggaatccttaccgataatgcggggctgctggcgggcctcggtgtgccactgaatatccacgatcagctcttgcccaatccttgcatcatctgtccgaagaattggatcgcgttaccttcgataagccagtgcgccataccacacacaaacagcatggagacgatcttggccaggctcataccgtgtttgaagatgttgaacgcggcaatgcccacgactacgaccatggcgacggctcgcaccgcggactgaccttcacctgccttgatcgtcgtccattcgaagaggttctgcgattccagtggcagcaggaggaattgatcgagcatgagaggttttcctttcaggaagccgaccgggatggtcccggtactgacgggctggacggcacgggtgtgccgtccggaggcagaaggcgtgacggctggtcgagggaggcaacctcccagcggcctgcacgactgacaagagtcaggccgtactggctggtccgggtggtggattcgtcgccggtgggctggcatgtcacggtcgcggtgacagcgatcttctgccggtctgagggggtggggatctcgtcaggccccaccacatgagtggttttcactgatacgcatggggctgggtcaaccgcggtgaaagcggtccctgggctactccatctcgacaggtcgtcgctgccactcagcatggcggttaggaagcctgaagaggcttgggcggccgggtcggcggtgcgaagctccgaggtgtctagggtgggggctgaggccggtgcaggcatggggatctgtccaggtagacgcaaggcgatggccttgccgttggaatcgacgtggaccgggactgaccaggcctgtccggtcccggattggccgcccatggtgatcactgtgacctgccacaggctcggatcagacggggagacggtagcgtcataggcggtgacggtggtgggcgctggaccaggtttgcggggcatgcgcgcatcggtgatcttggccgccaccaggtgctccagattgtccaagtgcccggagtcagaggtcagcagaagagtagtcacctcgaccgcggtggctgaggcgatctgagctgtgcggcggtcgtgatgggtggtgtcagtgctgacagctgtggtgggagcggatgccggggccgccgaacggaccagggcaacggggccgcatgcgactccgcacaacacgagggcaaggaagcctttggtggccatcgatccggtgtggggccagggacccacgttttcctgtgcctgttttttcttggccgaccaacggcggggcttgggctcagcggatgcactttctgagttacgtactcgtcccaatcgcatcggtcacctccttcactggatgaagggaccaaggaggtgaccgatgtgcggtcga

SEQ ID NO: 208 - DNA, 9744 bp, Propionibacterium acnes
gctgacatgcaccgcccattgctagacgctgtgctgtggcatggctggacgtctagcagacgggttgacatcacctttaggctggcagcgcccgaggccgcaggccagaggaagcggacagcctaacgattgacgtccccctctcctttccccaacctcctggagtcgatgacccggagatagatcgatgtctatgcatcggtgcatcgatatacctatgtatctgtctgtggtttttagaggccactcccgtcgccccgggccgctcagcgataccgcaaggctgtgtgggatcagctgcgccgctcccccgacatggcagacagcaccctgcggactgactgacactgtggcgccgcggaggtctcccgcggcgtccgctggggcgagtgcatgcctgtcagctcatcttttatcgtcatgtttccccttgtcagagcgggctttgcaaagtgacaacgttggggggcttgacgacaacgtcctcgacaaccccgaggcggtgatctgtgtcttgtcagatcaaccgcaacgggaaagaggcaccgctgatgttcgccaccacagctaccctcaacgatgaatgggaccagattcgcgccactgagatcgattggcatgactgccccgaactgatgcactgcgtcaccgccgaggatgtgctggccgtcatcccggccgcccccgacgccatcttgggctacctcattacccgagctcaggacggtgacgaattagccacccgcaccatcatccaagcgttcacaggcaagcttattttgatggccacggccaccaaggtgcgccgtactaatgacggcttcaatgatctgctggcggggttgtgggagacgatcatcacgtacccgttggatcgtcgccctgacaagatcgctgcgaacctcaccctcgacacgttgcaccgggttacccggttctggcgtgctgattcccccgatgaggaagacgctcacggtctggtgcccttccctgacactctcatcgccccagagcccgatgaggacgtcacagctagccaggccatcgccttggcggtggaccgcaactggattaccgaggacctagcccgcctcatgagccatatttactgtgacggtatgactggagctgatgcgggtcgtctgcatggctgcgctccagctacggtgcgatctcgatgccgtgatggtcgggccgtgttgcagcgcaacgccgagacgatcctggccgtctgctgatccctctcttgctcatgcctgccgccaccctacccctacctgctagaaacatagccatgtctccagcaacgcatctagcgtatcttctagcaattgatctagctatgtatatagctgatgatctagctatcatatagctgtgtctccagcccaaatgacagcccaatggcatgcttgccacaggaaggtgcgtcagcctcccgaaatactggaaggagctttagcgtgcaggacatgaccagtcctattgaccgatccccgttcgaccgcactattgcggtgtggaaccacaaaggcggcacgttcaagacgtccgtcgtggcgaacctgggatacctgttcgccgccggtggcaacaaggtgttgatggtcgacatggacccccaggccaatctcgacatcgacttcggtatacccgcaggagaacgtgaacggggcatgggattagccgaggcgctacgtgaggggactgtccttcccccaccacagcatctcagcgaaaacctccacctggtcagtggcggcgctgctctcaacgagttcaccgaccccgcatccttagcggccatcatcgaccgagtcaccaccgagcgctacgacctgctagctcaggcccttgccccgctggcctgggactatgacctcatcttcatcgactccgggcctgcccaaactctgctgtcccagaccatccttggagtagcccgctggctggtagtgcccacccgcaccgataacgcctcaatcactggcctcgtcgacgttcaagacgccatcgacggggttgcctcctgcaaccctgaccttcaactactcggcgttgtcctagccggcgtgggggcccgggccacccggatcgccgcagataaacgccacgccatcgacacagtgctgggggcaggaaccgttttcgatgcggtcatccactactccgagaaggtgtccgtgctcgcacgccagcagggcaagaccgtcgccgagctagccaacgagtaccacaacacccagcccgcctacacctacctagctaaaggccagaacatccccaacgtcgccaaggcagccgtcagcatcgaaactgattatctgaggctggccaccgagatcagcgaccgcatgttcaccagcgacgagcaggagcctgatcatgactgacgatccgactccatccgagcagaacaaccccaccagcgacgacatgcgcttggccgaagaatgggccaacagcggccgcacagtgggagccctgccgcgccgtcaacggcctcagcgacccacaccccgcaccaccagccaaccccctgtctcgtcccctgacacaccggctccgaaaaaagcccagaagacccccaccagccagcctggccgtcaacggatcaacgtcaccgtctacgttgtgcccgaactccatgagcggctgcgctcccgatcggcggcgacgggggtgacggtctcggatctggtggtgcatgcgttagcgttcgtcgccgatcatgcgggggaggcgatcgccgatgatctgcgcgtcgagacgggccccggcatgggggccggactgttcgatgtgaccccatcgcggccagtaggggtcgccaaaacccagctgggggtgcgaatgacccgccacaacaagaatggcttggaccagctgacccggacgagtggggcccgtgaccgcagccatcttgtgtctgtcgccgtgcgcgactatctcgactccaaccctgtaaagaaaggccgacatgtccgctgatgaaactcctgccgcccggggtgggcgacgctttgatacgaccgtcaagcccaggcgccgtcccatgcttatcgccgccggtatcgccatcgtgatagtcggcgcgctcctcatcactcagttgattcgctccgcccaaaccgagcatcgcgtgctggaagtccacgccgatgtggctcgcggcgaggtcatccgtgacaccgatctggtatcggtgactgtcggccaggtcgacaacgtatcaacggttcccgcagaccagctcgactcactggtcggcaaacgcgccacggcagatcttcgagccggatcactcttgcctgctggggctatcggcccggccgatgtcgttccagctccgggcaagtcgctggtcgggctgaagctagccgccggacagatccctatcggagaccttgctgccgggacgaagctgcgcctgatccagacgtcggcacccagcggctcatccaccaccactgatagcagcaccaataccgatggccagtcgtgggaggcaacaatggcgaccggcaccaaaaagaccgagcaggtcaccttgatcaacgccgaagtgaactcgcgtgatgccgcccggatcgcccaactgacgtcacagggccgtatcgccgtagtgaaggatccgatccgatgagcaccattgttttgaccagcgtctcgggagccccaggggtcaccacgacagcgatcgggctgggcagggtctggccacaatcgagcctggtcatcgaggatgacacccaccacgccatgctggcgggctacctgcgagcctcccagcacgccgaaccgaacctggccgcagtggcgaacctgacgtcgactccaaccaacgcccaaacggtgtgggaatctatcgccagacccctacccaccgatgacccagtcggcgggctgcgacgcaaaggcatcctcggcccgcccacgccgtggtctcgcgcaggcatcgacccccgatggggattcatgctggccctgtggcggcaactggaggaggctggcatcgacaccatcatcgatttgggtcgcctagccacaccactgacctcaacgccacacctgatcgccgcacccatcgtcgaggacgccgacatgatcttggtgatgatcgaggcgacactacgcgacatcgccggcgcccgcacgatggtggagggactcgctgagcagatgaacttggccggcgcctaccgacgtctcggactgcttgtccaccgtggcggccaggcccgcggcgtcgccgagttcaatgacaaggagatcacctcggcgttacgactcccggtcatcggggccattacccatgacccggccggagccgcccaactctccgacggggtcgggcagcggttcgacaagtcacgtctggcccgctcactatcaaaggtggcggccagcctcgtcgatgccataaacaagcgccacgctgatgacgaggaggatctgtgatggccagttttgctgataatccgttcgacaagctgcgctcccaggatgcggcaagagcttcggtagagcaggagcctgatgccggattagcgtcggagttgttttcggcgtcgtcggggtgggccagctctcagcaggtgtcccaagctcaaccggtgatgacccgttcggagaacgtggattggccggttgtcgcggagctagccagtacggccactgatgaggttgaggctgagatcagccggtggagttccactcatgatggggtggcgacgctagacattcgccaggccatcgcggagcctgctattgcctcggcggtgtctacgtatgctgaccgacgccagatcgatgtaggggagacctggcctgatctggtacgccagcgataccgcaaggctgtgtgggatcagctgttcgggatggggcggttgcagccgctgttcgaaatcagcgacgccgaaaacatcatcgtggtgggtaaccatgaggtggttgtcgaccacaacgatggttcccggtcaacgctgccgccggtggccgactcggatgccgagctggaatcccagatcgcccggatggcgaggaatgcgaccccgcggcgagccttcgacgccgatcacaccgatgtgacgatcatgcaccaacagaagttccgtatccacgcgatctcagcggaagtgtcattgcaaccgtcggtggtcatccgccaacatttgctcacccaaatcagtctgggggatctgtcacatcgcggaatgatgccggtggaagtggcccggttcctcgatgaggcggtacaagctggcaagtccatcgtggtcgccggtgagcagggtgcaggcaagacgacgtttttacgagcgttgatccacgccattccgatgcgggagcggttcgccacgctggagaccgatcaggagttgttcgctcatctgatgcctggccgggaaaacacgctggtgctgttcgcccgtgatggtaacggcgaggtggatccggcgactggcacccagcacggcgctatcgagatcgcccagctgattcctcctagcctgcgccaggcgttaactagggtcattgtcggtgaggtgcgcggcaatgaggcctcggccatgttccaggccatgcagtcgggtacaggcaccatgagcagtatccactccccgcgagcctctgaggtgccgtcccggctagcccaaatgatttcgatgggcccggtctacgatctggatcaggccatgctgcagatcggtcattcgatcgactacatcgtctttgttcgtaagcgtgacctgcctgatgggagccggctgcgatttgttgagcagatccgttcagtctcgcctggtgattcgacaactcccagtcttggcgaggtgtacacggccgatgcgtggaccggtcagccgttgaccccgctcatgcctggttcggccgccgacgagctgtctcacttcgcccgagacctggattactgcgaggcccactcatgaacactcccgcactaaccagcgccctcatcatggccgggctagggctgatcctggccatcgacgggctggtcccggcgccgcctcgacctggggccccgctgagcccggcccagaggtgggccaggctcacccaccgtcccacaggagcggccgggcgccgccgggatttgcgttgggggttggctgttctcgtcggcgtcgtgctgtttgtgctcaccgggtgggtggctgcgctggcgttgggccccatcattgtgttgttggcccccaccctgctgggggcggccccaccgaccgatattccgctgatggaggcgttggatcggtgggtgcgtcaggtcgctgcggtgctgccacaggggcgagacatcatcacagcggtgcggatctcacggccgcgggccccgaagctgatcgccgggtcggtggatcaactggtgtcccggttggatggccgtatggagccgagggaggcgttccagcggatggccgacgagctggactcggctgaggctgacgcggtgctggcctcactagcgttggcggccactcacccgcggggagcctcgacaacgttgaaagctattgctggcaacatccaacagcggttgaaagtgctgcggcaggtggaggctgagcggtctaagccgcgtaactcggtgcgccagatcacactggtcacgatcgccatgttcggggggctgctcgtgatcggacggtcgtttctggccccgctggcgacccctcccggtcaggtgctggtggccgtggcggtggtcatgtatgtcatcgcactagtgcagatgtatcggatggcgcggccccgtcgacgcacccggatcatggttaggaggacccgatgaccattactgctttgtccctgctggtcggggccatcgtcactgtcggactgctggtcatcgtggcagcgttccgcccagccccaggccctgacctgtttgccgctctggaggtggtgtcgggtcgcacctcaagcgtcgccgagaacgtcgaccagacccggatcgggcggataggtcgcagcgtgacccgcacattccatgtgtcggtgtccccggccatgcgggccgcactgcgactccaaggcacgacccccgaagcgttctacggtcgacgcctgatctgcgcactgatcggggcgatcctgccgtggctgctcaacgcggtagccatcgcggtaggggcgaattccccgaacctactcatcccttcggcgctgtgtgtggcgttagctggcgctggatggatgctgccggcagcacggttgaaggctgcggccgggcccaccaacgatgactcgttcgaagcgctgctggtattcatcgatttggtcgtgctggaacggctcgccaacgaaacctccgtcgacgcgctcaccaatgcggcaaacatgtcggactcgccgctattcgtccagatccgtcaagtcctcaaccgtgcctccctggaaaacgtcgacccgtggaacgggctagaccggctagccgaggacatcaaactgcccgaactcaccgatgtggtctccatcgcccgcctccaaaacgaaggcgcctccctcgtcgacagtttccgggcccgagtcgccgagttgcgcgacgcctacctgctgcgcctgcaacaagaatccaccacgatcacccagcggcttggcctgtggacgatcctgcaagccggctcggtcatgctcatcttgctgggggcggccgccctcacactaatcacagccggataaaacgacaccgtgtcgagcccccatatgggccgcgaacctttcataatgatgcctgtaagcaccacaatattgatcacaacctaacaatgaaggagaaatcatgatgaccgatctcgacctggctaaaaaacagatcacctggctggcggcgcacctgcgttcccggatcgttgacgagcgtggcggtggtagctctaccgtggagacactgatttggattggtgtcatcgtggcgctggtgattggtgtgggcgtcggggtgacggcctatatcaggtcgaagatgcctcactgacgacgatgcgtagcaggttcacaactgatcagcgtggcggtggtagcgcgtcggtggggatgctcctgctgatgcctgcgatcatgctgctggcattcggtgggatcgaggtcgggatgtggtgtcacgcccatcagtcgaccatcgcggcagcccaaagcgccgcggaagctcagcgtgtcgtccatccggtcccggggtcggcacaggaggcagcctcgcagatcactagtcatggcggggtgcgtgatacccggatatcggtcagtgatgacggggccactgtcacggtgaccgtggtgggccgggccccatcgatgctggggctgcatcttcctgctgtgtcgtcgacagcgtcgatgcccaaggagcgcctgtcgtgaggcgaagtgagcgcggtggagcaagtctaagcgtcgaggtgctcatgtgggcgccgatcgcgctggtgatcatcgggtttgttgtgggtatcggccggatgtcgatggcccaggacgcggtgagtggcgcggcgggtgctgcggcccgtgcggcgtcgttggagcgtgatggacagtcggctcagtctgcggcgcagcaggcggcgtcggcgaacctgtcgtccggtgggctggcatgtgcgccgagtgtgagcgtggacacgtcagtgtttgcccgtcctgccgggcaggcgggcacggttcacgccacggtcacgtgtgtcacctcgctgggtcttgggttcgggtcccggacggtgcacgcaacggggtctgccccggtagacacctatcgggaaaggagaggctgagatggcccgtgatgagcgtggtggcggctcggtgtcggtgtggatgctgctcatggtgccggtgattctggtcatggccggcctggtttttgacgggtcccgtcagatatcggcaacccaggcggcccaggacgcggcggttgcggcatcccgcgccggaactgatgcggcagcgacaccgcagcttgctggccacgacggggcggccgtagcagtccaagcggcccgccaggcactatctgctgccggggtggacgggtcggtgcaggaggacgggtcgaccatcacggtgaccacgtctcaaagtcggccgacagtgttcctgtcagcgatcggaatcagccaggtaagggggcatgggcaggcccatgctcagcttgtgggaccgggagaacgcccatgacagtgatacgtcgtatcggtgccctggtggcactgctggtggtgatagccggcttaccggccgggctcgtggccgcaggcgccccgctagtaccctcgggcctgtcatgggcccatgtgcggcatctgttggttaccccagacatgaccgggtcggtgctggtgtggctggtcagcctcatcggctggatcgggtgggcatggttcgccctggccgtcgcagccgaagcggtgacgatgctctcagggcagcggctgcactggcacatgcccggccctcgcctagtgcgccgagtggcagccggtcttctcattgccgcgttcgcggccgcaccggcagccacaagcacggctcacgccgccgaggccacccatgtggcggtcgccgcccaggctggaccggcacacgcggccggcacccaggacagccccgccaccacctctcaggccccggacgcctccaccactccgaaaatctggaagacctacacggtgcgggccaacgactacctgtggaagatcgccgagcactactacggtgacg

SEQ ID NO: 209 - DNA, 1127 bp, Propionibacterium acnes
accccaactcgcctcaccacacgtcgacctcgacaccgatcaagcgacccgtatcagcgacattgccgtaccgctgacccgcctggtcctctagccacgacaacgcatcccggaacatccgcacgtcttccaaagcgaaaccgcagtcgtagccgcccttgtcccccaaccgcacaatctggcgctcccggtggcctccctcgtcgacttcgatccatagtttcgcgtgcatccgctggccgcggccttctgacaggatctcggtgagcagatcggaggcttgtcctcgcgcatcctcgttgtcgcgagggaattggagtgtgtgggaggaacgacgatgggggaggttggtgacctcgtgacgcagcaggttgcgcttgtgcatctgccgttcgagacgctcgggctgacctgttgacggggttgagccgtggcgccgcttcctcggcggggtctcgatccgttgctcttccggcggttcggcgtcaggttgtggtgcgcgatctcccctaagacgggggggctcgccacctatatccgagggacgatgagacggccttccacgcttgctgcgcactttcgcagcccgccccttgcggtcacatcgacgcggcggcggagtgacgtcctcaccgcgcgctagctgcgtcaacgccgacaccaggttggtgcccggtttcagcccttttagcacgaaccgcaccaggcgggggtctcggccgattcgtcgggcaatctcggcttggctccacccttcggctaacagggtgcgcaacaagtcttgggctcggttatcacgctcagtcactggtcgcctcctcggggagtcctgcctgctcggcctgctctgatagagcagcccgttccgatccggtctggggcgcttccaaagggcccggcaagacacctttgacacgcagccgcccgtccttgccgtcatcgccgcccccctgggccacagggagcgcccaggggggcacgttgctggtgtagatggcgtcgccgtggatagccagcacggtgcgggagttcatgcgtagtgctcctcccttggttgtggcgttttttccggtggtggggtcggcgatgggtgtgttgagggtgcgtacgcgggacagggcccagat

SEQ ID NO: 210 - DNA, 718 bp, Propionibacterium acnes
ccggggccctgctgctggtgtgggacgtcaccgttttgaccgggcccactctcggccaccgcgtgcgtcctctcagtaaggacgccgagctgactgcccggcgctggctcgaccaggtcgccgacaaccccggcttcctcgacacccttatcgaggccgcccgcatcaccgagggatggcatcacgcgacgcctccgcacattcaggccccttaccggacccttcatcagtgaacggaggtacaacgacatgaccagcgacattgacattgaccggacccacaaacccgacgaccgcgccgaggctcctctttaccgagcctgggccaggagactcgtgcacgtctccgggatgccctggcgtatcgtcgccgccttggccggggtctcccccacctccatgcaccggcttctattcggccgcaacggtcgacccgtggaatggatcggcatcaatgatgctcgcgccctgatggatatcggcatcgatgatctcgcctcagcgtccaccgaccgtatcccggcccgcgaatcccgcgagctgttggtagccctgcacaccctcggctggaccgatgagcatctaagccgctggctgaccagttccgacctcgacctggccaccacccccaaggccctctacgtcacccggctatccgccgcccgcatccaggccacctacgacatgctcatcagccagcccgtccgccgctgcggcc

SEQ ID NO: 211 - DNA, 11765 bp, Propionibacterium acnes
ggtcagtgggcgatggccaggccgacgagggcgccgctgcacaggctgggtgcccagggaaggaatcgggcggtgtggtatcggaaccgatcgattagggcatatagggcgatcagggtaagcccggctatgacagtgacctggatcgtgtcgatgccggttgctgcggccggcgctgcccacagtggtgtgatacgcacgtcggagaagccgaagccgcctcgagagatgacccaggcgatcatccacgctgcgaagatgatggtggtagcgatgacagcacgtgttgccgcagtctggtccgagagggcggtaacgactacagccccgatccatccggcccatccggtccacgctagggctgccggtatccatgtggtgatggcgtcaatgacggcaacccatgccccgatggtggctagcagggcccacgtcggccatgtgggtgctggggcccatgctgtggcggtgatcatggtgagtgctgctgcggtacagaccgcgatcaagcttcgggggctgtaggtgtcgcggtaggcgatcttgtcgggattggcggtagctggttcgggcaggatgcgagtgagggcaggccatcctgcggccgcaatagccacgacggcgaccacccacacgatctgttgcatgggtctcatcatggcccatcatcgatgggtgtgggtggccgacatggggtcactcgtcgaggaggtcgaggggtgtgcgggcaagcatggcttcctgtgtgccgagcatgagggtgccagagtcgtcgccggccgattcccagtcgacgatgacctggtcgccgtcaacgctggattcggcgatggtcacccattgcccgtccatgtcgatgagcatcccggcggccagctctgtggcggcaaccgggcggggtgggctgtagaggaggtcgatgtcgcgggcaaggtcgtcgggttcttcggttacctcgggtggggtcgatctggctgtctcggtgtcgtcggccaggtcggctcccaggatgcgttcccattcggggctggttttcttgcccgctgaggccatcgtctcgtcgatctgttcgtcagtgggccacacaaatttctttttggtccaggtcgtggtgtcgggtcgcagctgatccagcagttccaggtcttgcggggagtgggccttgcgggggtcgggggtgtagaagaattggacttccttgggggctgattcgccggataggtaggtgcctcggccgcgtttgccgaacgggatgcccacgccgacgtgttcggagccgaacatcatgcgggctccgtcagcggacaggggtccggtggcggcacgcccggagaagttgtctcggatttcgccgcccaggaactcggcgtcggggcgttgggtccccagatcgacgtggatacggcaggcggctgccatgcgcagcagggagccgatccagccgaaaacggggcattctccgggcatcccagagaccttgatcgttgaccaccagtttttcgcgttgccgtagaactggcggtactcgtcgatgaggaccagcacgcgggtgaagtcggtctcgcgggccccttcttcttcgatgcggcggtagcggtcctccatgagagaccacagccagtggatgagggcgacctggtcggggacggtagtggcgaccatctcgatgttgggccactcccgcaggcccaggtactcgatgcgtttagggtcgatgacgaagacgcgccagttgcggcgggcaccctcgacggcgtcgccgatcatggacaccgtttttccggtacgggtgcggccggccttgagctggtgcgccatgacaccggagatgtcccagaaacaggtgttgccgtcctcgtcgacggcctgggggattttctcccagtctggggagtctgggcccggaagggccacgggtcggggcaccatcgagggcagggggtggcggcgggtgacggtgatggtgtcgtgttccaggtcgaagtcgctgcgccactggccgagcatcatcgccgaggtcaccgcggccaggcgcaattggatgttcgggctggacaaatgggcgccacgttggtggtgaatggtgaagccgtccaggttcccccgatcggttttccaggaatcgacggtgaccgccgacccatagatctgagtggctacttctttagcccgttccttgtctcggtccagatcggttttgtcagggtcaggggtcggggcgcggtattgcaggacgaaccggccggccgggatcgttgcggatgtcaccgtgaactctgccggcgaccaggcagccgcggccgcctgggtgagggccattggcatggtctcgacggcagcctcctcgggggagatggtgagggtcaggcgtcgcggatgcgtcttcttgcgattccatgtgactttctgcctcaccggcaccttcgccgccgactgaatggctaggcgagctgattcggcagtttcggtacgccggccagcgcgtagcgcccgtcgtgcgtgaaggctgcccaccacagcacagcccatacacggcagccaccagcgcggatcagcggctgctgcatagctccccgtagctagtaccgcacctgaccagccggccgcgatacttttccacgccggtttcgcgccaccaggaccagcgttatggacggtctgcttcgaggctgcggagggacgagacagcggagtgctggtcatgccgcggcctccttgtggcaggtcatttcacaggcatgccggccagcgatgatgccgtggcgcaccgccccggtagccgcatagaccgcgcacaactcaaacacggggcacccatcgcaggccgccgggttcatgctttctttgtcccacgatggtgggtcatcggtgcacggcacggccaggccatcctgttgagcggcgctgatagcggtgaataggcgcagctgggcgcgaacttggtctggggtcaggttgacggtgcgggctacacgcatggggttccttcctcttcaccagtgaaggttccctagacccggccgatgtgcggagggatttcagtgttttatcgaggtgaccagccagccggtctgcgctgcgggttcaggtaccagggtcagatgcagcatggtgtggtcggctaggggcacggcgaccaggggcccgtcggcgctcgccccggtgagggtgggagttccggccacggtggtggcgggaatctggttgggtttcgcggccatcagggagcccatgagggtcggggcggcgatctggacgagggcgactttgcgggcggcgggatcgcgggtcaaccagccgcgggtgaaggtgagcgcagccgacgtgatatcggggctcagcggggctggtgtggcggcggggtgggccgttgaggagggccatacgcgcggtagcgctggcgacatcgagcgggtcggagtggggtcaggtgtggggcttagggtccgatgtggcgatggggctaccgccccggtggtgggagacgagactggttgggggtggtgttgagggcgtgggatcagggtgaaggcagccaaactggccgggatgaggatgacggccgcgccgacacttcggagcgaggtcatgtgacgatccttcggtagctcgacgggttgccgtagatcttttccacgttgatgccactatgtgggttgtcggcgctaaccatttggcctccaccgatgtagacggccacgtggtgggcagggcttccccagaggatgaggtcgccgactttgagctggtcacgggccacagcagtgccgactttctgctggtcggcggcggtgcggggaaggctaatgccgatacgccggtacagcgccgaggtcaggcctgagcagtcgtagccgccatcggctttgccgttgccaccccacacgtaggcgtaggagttgttgtcggcgatcgatttggcccatgccacggcttcggccaggttcttcgacacaccggtctcgttagcggccccggtggcacagttgtttgacaggtgccctgtagtagtggatcccactatttgtttggccatggtttcccatttggcgtaggcatcgggcagggctgagccttgcactgcctgagctgcctgcgtcagcggcatcttctgccagtcagcgatgtcgactaaaccgggaatgtggaatccagggccgccggccgatccggggccagcgtaggtgatggtgtggcctttcaagaacgcctcggtggcgtaggcatcattgttgacctgatccagggtcccgtaccagcccggcaggatgcgctgctgaaaggggccggcgtcaccgtcaccgttagccttcgctgaggtagggtcggccccaagatctgattcttgtttggcggtcatgatagcgatgaccgctgcctgggtaggcagtttgtcacgctggaccacagtgacgatggtggtcacgagctgcttctgcctggccgtgaggcctccggcacccacagtgcctccggtgacggtacccacgcaagcatccccgccgacactgccaccgccgccgccagagttgtcgtcgagggccccagagcctactgacagcagcggcacaatgatcacggtcgctggcaagaccgccaggcccgccagcatcagcactgctgcactcaccacggcgatcacgtgagatgctttcaacgctgcccacctctcgctggtttgagggggcgacgcctgctggtacgcacaggcttggttggtccagtccgccgttggttggcaggcctgggtttgatcggcttgctgggacccggtttgggctccggagtcttaggctccggcttcacatgcctaggcacttcggctgcggtgggaggagtcagcacgtggcgtactggcttggtgaccttctgggcacccgaaacaaccggcttagacaccaccttggcacctttgaccaccggtgcggctgccttcgcgccggccttcttgactgcacgatgcgctttgatagccccggcctcggcccggccaaccctgctagcagtagcatcgagggctctgtggcccgtcgttgccctcaccggtgcatccttgccctgacgggcctgcttcgcgatcatcgacataccgccccgcaacgccgaaacacggttgtgagcgtgggcgacggccgacataccagctgtcgtaattttcgactggccctgcggagctcctcccccggtacggatctgacgatatgacgccgaagcacgccgcgccgccgaggccattcgcgccatcttcgcagcccgggtcactcccaccgacgcgccaccggtgactaccgcagccgcagccgaaaccatccgccttcgacccaatccagtgagcttgcgaccaccgctgcgcaccatccggcgagcaccccgcccagcccactggccaatcgccgacgccccttcagagcgcttactacgcatccagtcgttgatcttggccctcagcccctcctcacccttgtgactacgccacagagacaccaagaatccgatgattcccacgatttccaacatgttgacgaccatgaccttgatgacaacgttgccatcagaggcgaagaccgacttgatgacgagcatgaccacgcccaacatcaccatcgacccaacaatgccgatcatcgagtacaagatcgaacacagatcccggataagcgggtctgtgcgaccaggaatagcccgcaacacgttgagcatcgacatgaacgccgaccacaccaacttgcacacgtagaaccagcacatgcccgcgaacaccagcaggattgctgccaaacccgccaccgtcgacgagtaaaagaagaaccccaccaaccaggaaccgtccgcaatatcgccggcgtaatccgacaacccctcgtcacaatcaccaaggtcgtcgcgagcatccgagacgtcatcgtaagggccacccttgagcacctcgatgtacttgtcgtggcacttcgcatcaataatccggccatagttgagctgctgatgaaccggcgccacgaacgagtccacaatgatcgccgacagcttcggagccttcgagtctcccgtcgaggtcatgtcatcaggaacctcaacctcaccagcggtcgccgtcccaggatcaaccgaactagtaatcatccgagacagcgccacaccgaactgctgggtgcgagccaacggagtagccaacgtcgtcgtatcacctgcaaaattcgccaccggggccgccaagaaacccaacgccagcgccgcagcaatcgccgcacgcgcacccgtagcccacgccccagccgtacgtcccctcatcatcttgacgaccacgcccacaccggcgcacgtcgtcagcaacgtcaacaccgttccaccccagctgtccgctcccagcggggccaaaaccttgtcgtggatgtcgttctgcaaccccaccagcggtccggtaatccacccgacccagctcatcgccacggtccagtccaacaaccggcacaacagggcaacgaccatcaggtacgtgttccaacacatgccaataatggaggcccacatagccttcagcggggccgtaacgccaccatcgtccatcgacatctggtactgaaacaagtgaataccgttggagtcagtcacattgaaaccgtcacccatccagcccagcccaggacccgacgccatggcaggcacactgctcagcgccaccaccagaaccagcgtggtgacgatgatacggaaccgccgctccccggccccggggcggcgtggatgacggctcacgctgtctcccggtcgtgctcgggcgggttggagctggcggcttcgcggtggggagcgtaggcaggtctcagtagtcgaatttcaccgacgttgccgtgttggtcggcgtacaggccacaaccggggcctccggggttgagggcaatcttgaccaggtcagcgaactcttcaggggacgttttagggtccacgcccaggaactcgacacctttctgggcgaggttgatgttgtcgcacagcaacacgatgcgatgctgaatgaggttgcggacggtctcgttggggtaatcggcctcggggtcgtgggagccggtgataagccaggcattggctcggcgggattcgcgcacgtactcgtcaatggcgtgggaggcttccggcgaggacgacatgtgatgaaactcgtcaacaatgaaagcggcgtcgcgggcccggtcgctgaagcacaccaggcgagccagacgggcaatgagcgcgtagagggctcggccaaacaccttgtgcgggggcagctgccgaaacaaatgttctgacagcatctcctcggcgttaggaagagcgatgccacaagtgccaatgatgaggatgtcggcactcaggtcggcgggaggaaggtccgggtcaaagatggccgaagctagggaggccgagttctcgatgtcagcgaacacggcaatcctgtcagcgatcgcggtggcctcgggaaggtcgcactcctcggccaggtggcgggccaaacgcccacacgaggtgatctggtggtcacgcatgtaggccggtttgaggaccttggccagcgtggtcccggccacaccgatggtctccaagttaagcaaggtcagcaagaacgactgggcgacctgcccggccatctccgggggaaggatgcgcagcgggtccagcgacagcttggggtgggccgtgtcgacgatctggcgtctaaccccgtcgatagagttgacaaaggttacccactcccgctcatcggagttgtcggtggcaataatgcgcccgccccgggccgcgatggctgcgcacagccgcttctcggccatcgtcttgcccgcgcccatcttgccgatgaacgccaccgtgttgcctttctgatcctgagtgtcggcatgcaaatcgaggtaggccagcgactgcaacggggagcctgtgaccacagccaacgggatgccggtggtacggcccaaccggtactcaaccaccgggatagatgcggcgaacgcggaggcgtgagtcagctgacggtaggcgttaagcgaggaggagaaccggccaccgggccgggcagcccacagcaagtcctcctgacggcccacgggacgcacccacgtgaagtcaccgaacaccggatcattgacgaacgctcctgccagctcctcggtggtctcaaagtcaggagacgagacagtgacggtgataagagcctggatctcgacctcacgctcatcggcggccagctcggcgttgtagtcgacgagcacctgagcggaatgctcgatagacatgagggtcgaagcctgggtcatctcaccgccctcgacgttgtcgagctgatcgaccgtttgacggatagcccgctgatttttctgcatcgcagcgtgacgggtccgggccactccccggatcgccacgtcgaccggcacgccagtgtcgtcgatacggcccaaaaactcgtaggcaggccacgtcatcgtgcggggcaccttacccagcacgatatgggactggtagacggtctcgccggtgtcggcaccgattttgaggacgcgacgattccacgcctgagccgtccgggacatgtgggagactcgcttgtcatcctcgctggccagcaggtcggaggtcgcggcctcatcgatgaccaactcccccagcgcggcacgtccaacctcatccatgagggcgattccctcgccaggggcatcatcacgcaaccgggtcgggtggcctgacaggtgctgccgaagccagatctgttcatcaacggtgaccgggcggggttggaacgctgccggcagtttcgcaccgaattccttagcctgacggagggcccactcccgtgcgacacggccaggagcggtggtcatgagtccggcggcttcggtgattttgttgagggcggcggtccaggcggtgtgggtgcgtattttctggtcttggttgagtttgatcgataggaaccacacgcgccggcctagggattcggtttcaggctggtcgagggtggcgtcgatttcgtcggcccacacggggtgttcgctcaggtcgaggccggcggccatggcgtcgacgatttctgtggggtcggtccaggtgagggctccgttgaggcagaactcgtggcgggcgagggggcggaataggtcgcggtgagctgcggcgacggtgagggaggcgttctcggtgacgggtcgctggaggggagtgagtcgccaggtggcccagatgtcgccggtggaggtccagacgaggttgtcgaagaggaaccgttcggggatggacatcatgactccttttcggcggcggcgaggaaggcttccaggccgctgcggcgtacagcgttcccggtagggtgcaggggttttctgggggtgggttcagatttcgaatgtgggaggggtttgtggatggtatcggtgtcctcggcgagggcttggtcgagcaggcaggtggccggggtgtcggtagtctcgtccagctcgtcgatcatctcgtcgaggaggttgggggtggtggatgcggcccacacaggtgggatagccggtgcgggtcgaggcggtgtggggaggcggagtttggtttggccccagaggggtgtgtgggtcatgccggcgggagtggtggcggcgtgagtggtcacacgccaccagcccgccagccatgccagaggtgaccaggtccagtcgatgcgaccaacaacgaactgggcgagccatccggcagccagcgcgaaaatgaaaccgcggatggtcatgcccccgtcgataattttgaagcccatcatcgcggcaggaactacgccgccgacagcgagcacctgatagatcgtgtagggcccgccaggaatccttcgacctgaggaatccttaccgataatgcggggctgctggcgggcctcggtgtgccactgaatatccacgatcagctctttcccaatccttgcatcatctgtccgaagaattggatcgcgttaccttcgataagccagtgcgccataccacacacaaacagcatggagacgatcttggccaggctcataccgtgtttgaagatgttgaacgcggcaatgcccacgactacgaccatggcgacggctcgcaccgcggactgaccttcacctgccttgatcgtcgtccattcgaagaggttctgcgattccagtggcagcaggaggaattgatcgagcatgagaggttttcctttcaggaagccgaccgggatggtcccggtactgacgggctggacggcacgggtgtgccggccaggggcagaaggcgtgacggctggtcgagggaggcaacctcccagcggcctgcacggctgacaagagtcaggccgtactggctggtccgggtagtggattcgtcgccggtgggctggcatgtcacggtcaccgtgacggtaatcttctgccggtctgagggggtggggacctcgtcaggtcccaccacatgagtggttttcactgatacgcatggggctgggtcaaccgcggtgaaagcggtccctgggctgctccatctcgacaggtcggtattcccggtcagcatggcggttaggaagcctgaagaggcttgggcggccgggtcggcggtgcgaagctccgaggtgtctagggtgggggctgaggccggtgcaggcatggggatctgtccaggtagacgcaaggcgatggccttgccgttggaatcgacgtggaccgggactgaccaggcctgtccgctcccggattggccgcccatggtgaccacggtgacctgccacaggctcggatcagacggggagacggtagcgtcataggcggtgacggtggtgggcgctggaccaggtttgcggggcatgcgcgcatcggtgatcttggccgccaccaggtgttccagattgtccaagtgcccggagtcagaggtcagcagaagagtagtcacctcgaccgcggtggctgaggcgatctgagctgtgcggcggtcgtgatgggtggtgtcagtgctgacagctgtggtgggagcggatgccggggccgccgaacggaccagggcaacggggccgcatgcgactccgcacagcacgagggcaaggaagcctttggtggccatcgatccggtgtggggccagggacccacgttttcctgtgcctgttttttcttggccgaccaacggcgggacttagggttagcggatgcaccttctggggtgcatgctcgtctcaatcgcatcggtcacctccttcactggatgaagggaccaaggaggtgaccgatgtgcggtcgaacccgaaaaagttcaaacttttttctgggtctgcctcaagtacgacagaaggcctgcatcatcacggcgttgtggtagcagatcttgcgtcagcgcaaatgtatgggcctcgtaggagtagctcttaggtgggtcccggtggttgcggccagggcgagggtgtcgggtatgtgtagcgctagtcccgggttcgtggtgtgagggcttttgggtgctgacatgcactacccattgctagacgctgtgctgtggcatggctggacgtctagcagacgggttgacatcacctttaggctggcagcgcccgaggccgcaggccagaggaagcggacagcctaacgattgacgtccccctctcctttccccaacctcctggagtcgatgacccggagatagatcgatgtctatgcatcggtgcatcgatatacctatgtatctgtctgtggtttttagaggccactcccgtcgccccgggccgctcagcgataccgcaaggctgtgtgggatcagct

SEQ ID NO: 212 - DNA, 2055 bp, Propionibacterium acnes
gcgagccacgaccatcgccaagctgaatggagagcgagcatgagcaccacccctgccgggttcgacttcgacgctctggccgagtgggccgagagcgatgaggcgacccacaccccgcaaaccagccccgtgttccggggcaaggacgccgcgcgcgccagccgcgcattcctcggccgaggacggcccaccctaggcgcggaccacgccaccggcgagggccggtcgccccgccgtcaggtacggctcgacgcacgcaccaacgcgcgactcgacgcctacgcagccgcaaccggcaccagcgcctcccagatcatccgcgacgccctcgctgactacctgcccgcctgatcccaccccaatccactcgggcgcctgtcagtgccccctcttctgggtggtggtccggggcgtcaccgccccggaccagttgggtagtcatctcagttgaaataagcgattagtgatacgcccctcatgctttccggtgctgtcatgagcgtctgacaacagcgacacctcggggcagccgacggacagtcctctggctgccgctctgatcccatgcccacggcacgaaggtgtcggacagctcggtctcgtcatgtgcccaaatagcgtcgtgggcctgtcgccaagcttctcgggagccccacacgggcacgaccgggccacaccggtgtcctggcctccagtgtcgcgacactgtcgatttcggtacgtgcaatgcggcggcggtttgacggatcgacatcccagactcccgcgcgtcccagatcgccatgtggagagtatttgcctccagtgcggccgccacacttgcacgctctcgcgcacgctcgaatgcccgcctagtgctctcaaatgtcgtcacgacgcctccccctgaaaatactcagggtgtcccacggtgggacaccctgagtatttcataccccaactcgcctcaccacacgtcgacctcgacaccgatcaagcgacccgtatcagcgacattgccgtaccgctgccccgcctggtcctccagccacgacaacgcatcccgaaacagcccgacgtcttccaaagctaaaccacagtcgtagccgcccttgtcccccaaccgcacaatctggcgctcccggtggcctccctcgtcgacctcgatccacagtttcgcgtgcatccgctggcctcggccctctgacaggatctcggtgagcaggtcggacgcctgccctcgcgcatcttcgttactgcgggggaattggagtatgtgggaggaacgatgatgggggaggttggtgacctcatggcgcagcaggttgcgcttgtgcatctgctggtcgagacggtcgggctgacctgttgacggggttgagccgtggcgccgcttcctcggcggggtctcgatccgttgctcttccggcggttcggcgtcaggttgtggtgcgcgatctcccctaggacgggggggctcgccacctatatccgagggacgatgagacggccttccacgcttgctgcgcactttcgcagcccgccccttgcggtcacgtcgacgcggcggcggagtgaggtcctcaccgcgcgctagctgcgtcaacgccgccaccaggttggtgcccggtttcagccctttcagcacgtagcgcagcaggcgggggtctcgcttgattcgtcgagcgatctcattctggctccacccctcggccaccagggtgcgcagcagatcctgggcccggctgtcacgctcagccacggctcaccccctcagggatgcctgcctgctcggcctgctctgacagggctgctcgttccgatccggtctgcggcgcttccagagggccaggcaagacacccttgacacgcagccgaccatccttgccatcgtcgccgcccccctgggccacagagagcgcccaggtaggcacgctgctggtgtagatggcgtcgccgtgaatggccagcagacagcgagttctcaacgctcctcccctggttgtggcgtttttcccggtggcggggtcagcgatgggtgtgttgagggtgcgcacgcgcgacagagcccagata

SEQ ID NO: 213 - DNA, 11284 bp, Propionibacterium acnes
gtccacgctagggctgccggtatccatgtggtgatggcgtcaatgacggcaacccatgccccgatggtggctagcagggcccacgtcggccacgtgggtgctggggcccacattgtggcggcgatcatggtgaccgcagccgcggcacagaccgcgatcaagcttcggagactgtaggtgtcgcggtaggcgattttgtcgggggtggcggtggccggttcgggcaggatgcgagtgagggagggccatcctgcggtcgcaatggtcacgacggcggcgatccacacgatctggtgcatgggtctcatcatggcccaatatcgatgggtgtgggtggccgacatgggctcagtcgtcgagaggtttgcgggcggttgtggcttcttgggtgccgaggatgagggtgccggagtcgtcgccggctgattcccagtcgacgatgacctggtcgccgtcaacgctggattcggcgatggtcacccattgcccgtccatgtcgatgagcatcccggcggccaggtctgtgacggcaaccgggtggggtgggctgtagaggaggtcgatgtcgcgggcagggtcgtcgggttcttcggttacctcgggtggggtcgatctggctgtctcggtgtcgtcggccaggtccgctcccaggatgcgttcccattcggggctggttttcttgcccgctgaggccatcgtctcgtcgatctgttcgtcagtgggccacacaaatttctttttggtccaggtcgtggtgtcgggtcgcagctgatccagcagttccaggtcttgcggggagtgggccttgcgggggtcgggggtgtagaagaattggacttccttgggggctgattcgccggataggtaggtgcctcggccgcgtttgccgaacgggatgcccacgccgatgtgttcggagccgaacatcatgcgggctccgtcagcggacaggggtccggtggcggcacgcccggagaagttgtctcggatttcgccgcccaggaactcggcgtcggggcgttgggtccccagatcgacgtggatacggcaggcggctgccatgcgcagcagggagccgatccagccgaaaacggggcattctccgggcatcccagagaccttgatcgttgaccaccagtttttcgcgttgccgtagaactggcggtactcgtcgatgaggaccagcacgcgggtgaagtcggtctcgcgggccccttcttcttcgatgcggcggtagcggtcctccatgagagaccacagccagtggatgagggcgacctggtcggggacggtagtggcgaccatctcgatgttgggccactcccgcaggcccaggtactcgatgcgtttagggtcgatgacgaagacgcgccagttgcggcgggcaccctcgacggcgtcgccgatcatggacaccgtttttccggtacgggtgcggccggccttgagctggtgggccatgacaccggagatgtcccagaaacaggtgttgccgtcctcgtcgacggcctgggggattttctcccagtctggggagtctgggcccggaagggccacgggtcggggcaccatcgagggcagggggtggcggcgggtgacggtgatggtgtcgtgttccaggtcgaagtcgctgcgccactggccgagcatcatcgccgaggtcaccgcggccaggcgcaattggatgttcgggctggacaaatgggcgccacgttggtggtgaatggtgaagccgtccaggttcccccgatcggttttccaggaatcgacggtgaccgccgacccatagatctgagtggctacttctttagcccgttccttgtctcggtccagatcggttttgtcagggtcaggggtcggggcgcggtattgcaggacgaaccggccggccgggatcgttgcggatgtcaccgtgaactctgccggcgaccaggcagccgcggccgcctgggtgagggccattggcatggtctcgacggcagcctcctcgggggggatggtgagggtcaggcgtcgcggatgcgtcttcttgcgattccatgtgactttctgcttcaccggcaccttcgccgccgactgaatggctaggcgagctgattcggcagtttcggtacgccggccagcgcgtagcgcccgtcgtgcgtgaaggctgcccaccacagcacagcccatacacggcagccaccagcgcggatcagcggctgctgcatagcccccggtagctagtaccgcacctgaccagccggccgcgatacttttccacgccggtttcgcgccaccaggaccagcgttatggacggtctgcttcgaggctgcggagggacgagacagcggagtgctggtcatgccgcggcctccttgtggcaggtcatttcacaggcatgccggccagcgatgatgccgtggcgcaccgccccggtagccgcatagaccgcgcacaactcaaacacggggcacccatcgcaggccgccgggttcatgctttctttgtcccacgatggtgggtcatcggtgcacggcacggccaggccatcctgttgagcggcgctgatagcggtgaataggcgcagctgggcgcgaacttggtctggggtcaggttgacggtgcgggctacacgcatggggttccttcctcttcaccagtgaaggttccctagacccggccgatgtgcggagggatttcagtgttttatcgaggtgaccagccagccggtctgcgctgcgggttcaggtaccagggtcagatgcagcatggtgtggtcggctaggggcacggcgaccaggggcccgtcggcgctcgccccggtgagggtgggagttccggccacggtggtggcgggaatctggttgggtttcgcggccatcagggagcccatgagggtcggggcggcgatctggacgagggcgactttgcgggcggcgggatcgcgggtcaaccagccgcgggtgaaggtgagcgcagccgacgtgatatcggggctcagcggggctggtgtggcggcggggtggggcgttgaggagggccatacgcgcggtagcgctggcgacatcgagcgggtcggagtggggtcaggtgtagggcttagggtccgatgtggcgatggggctaccgccccggtggtgggagacgagactggttgggggtggtgttgagggcgtgggatcagggtgaaggcagccaaactggccgggatgaggatgacggccgcgccgacacttcggagcgaggtcatgtgacgatccttcggtagctcgacgggttgccgtagatcttttccacgttgatgccactatgtgggttgtcggcgctaaccatttggcctccaccgatgtagacggccacgtggtgggcagggcttccccagaggatgaggtcgccgactttgagctggtcacgggccaccgcggtgccgactttctgctggtcggcggcggtgcggggaaggctaatgccgatacgccggtacagcgccgaggtcaggcctgagcagtcgtagccgccatcggctttgccgttgccaccccacacgtaggcgtaggagttgttgtcggcgatcgatttggcccatgccacggcttcggccaggttcttcgacacaccggtctcgttagcggccccggtggcacagttgtttgacaggtgccctgtagtagtggatcccactatttgtttggccatggtttcccatttggcgtaggcatcgggcagggctgagccttgcactgcctgagctgcctgcgtcagcggcatcttctgccagtcagcgatgtcgactaaaccgggaatgtggaatccagggccgccggccgatccggggccagcgtaggtgatggtgtggcctttcaagaacgcctcggtggcgtaggcatcattgttgacctgatccagagtcccgtaccagcccggcaggatgcgctgctgaaaggggccggcgtcaccgtcaccgttagccttcgctgaggtagggtcggccccaagatctgattcttgtttggcggtcatgatagcgatgaccgctgcctgggtaggcagtttgtcacgctggaccacagtgacgatggtggtcacgagctgcttctgcctggccgtgaggcctccggcacccacagtgcctccggtgacggtacccacgcaagcatccccgccgacactgccaccgccgccgccagagttgtcgtcgagggccccagagcctactgacagcagcggcacaatgatcacggtcgcgggcaagaccgccaggcccgccagcatcagcactgctgcactcaccacggcgatcacgtgagatgctttcaacgctgcccacctttcgctggtttgagggggcgacgcctgctggtacgcacaggcttggttggtccagtccgccgttggttggcaggcctgggtttgatcggcttgctgggacccggtttgggctccggagtcttaggctccggcttcacatgcctaggcacttcggctgcggtgggaggagtcagcacgtggcgtaccggcttggtgaccttctgggcacccgaaacaaccggcttagacaccaccttggcacctttgaccaccggtgcggctgccttcgcgccggccttcttgactgcacgatgcgctttgatagccccggcctcggcccggccaaccctgctagcagtagcatcgagggctctgtggcccgtcgttgccctcaccggtgcatccttgccctggcgggtctgcttagcgatcgccgacatgccgcctcgcaatgccgaaacatgattgtgggcgtgggcgatcgccgacatgccggccgtcgcgatttttgactggccctgcggggcccctgccccagcacgaatctgctggtaagccgccgacgtgccacgagcacccgccgccattcgcgccaccttcgcagccctagtcactcccgtcgacacgccacccgtggctaccgcagcagcacccgagaccacagtcgaggccatccgccttcgacccaatccggtgagcttgcgaccaccgctgcgcaccatccggcgagcaccccgcccagcccactggccaatcgccgacgccccttcggaacgcttgctgcgcatccaatcgttgatcttgtccctcagccccttctcgcccttgtgacgacgccacatggacatcaagaacccgataatccccacgagctcgagcatgttgacaaccatgaccttgatggcgacatcaccgtcagaggcgaaaaccgacttgatgatgagcatgaccacacccaacatcaccatcgacccgacaatgccgatcatcgagtacaagatcgaacacagatcccggatgagcggatctgtgcggccagggatagcccgcaacacgttgagcatcgacatgaacgccgaccacaccaacttgcacacgtagaaccagcacatgcccgcgaacaccagcaggaccacagccaaacccgccaccgtcgacgagtaaaagaagaaccccaccaaccacgaaccatccgcaatatcgccggcgtaatccgacaacccctcatcacagtcaccaaggtcgtcgcgagcatccgagacgtcatcgtaagggccacccttgagcacctcgatgtacttgtcgtggcacttcgcatcaataatgcggccatagttgagctgctgatgaaccggcgccacgaacgagtccacaatgatcgccgacagcttcggatccttcgagtctcccgtcgaggtcatgtcatcaggaatctcgacctcaccagcggtcgccgtcgcaggatcaaccgaactggtaatcatatgagacagcgccacaccgaactgctgggtgcgagccagcggagtagccaacgtcgtcgtatcgcctgcgaacttcgccaccggggccgccaagaaacccaacgccagcgccgcagcaatcgccgcacgcgcacccgtagcccacgcccctgccgtacgtcccctcatcatcttgacgaccacgcccacaccggcgcacgtcgtcagcaacgtcaacaccgttccaccccagctgtccgctcccagcggggccaaaaccttgtcgtggatgtcgttctgtaaccccaccagcggtccggtaatccacccgacccagctcatcgccacggtccagtccaacaaccggcacaacagggcaatgaccatcaggtacgtgttccaacacatgccaataatggaggcccacatagccttcagcggggccgtaacgccaccatcgtccatcgacatctggtactgaaacaagtgaataccgttggagtcagtcacattgaaaccgtcacccatccagcccagccccgggcccgatgccatggcaggcacactgctcagcgccaccaccagaaccagcgtggtgacgatgatacggaaccgccgctccccggccccggggcggcgtggatgacggctcacgctgtctcctggtcgtgctcgggcgggttggagctggcggcttcgcggtggggagcgtaggcaggtctcagtagtcgaatttcaccgacgttgccgtgttggtcggcgtacaggccacaaccggggcctccggggttgagggcaatcttgaccaggtcagcgaactcttcaggggacgttttagggtccacgcccaggaactcgacacctttctgggcgaggttgatgttgtcgcacagcaacacgatgcgatgctgaatgaggttgcggacggtctcgttggggtaatcggcctcggggtcgtgggagccggtgataagccaggcattggctcggcgggattcgcgcacgtactcgtcaatggcgtgggaggcttccggcgaggacgacatgtgatgaaactcgtcaacaatgaaagcggcgtcgcgggcccggtcgctgaagcacaccaggcgagccagacgggcaatgagcgcgtagagggctcggccaaacaccttgtgcgggggcagctgccgaaacagatgttctgacagcatctcctcggcgttaggaagagcgatgccacaagtgccaatgatgaggatgtcggcactcaggtcggcgggaggaaggtccgggtcaaagatggccgaagctagggaggccgagttctcgatgtcagcgaacacggcaatcctgtcagcgatcgcggtggcctcgggaaggtcgcactcctcggccaggtggcgggccaaacgcccacacgaggtgatctggtggtcacgcatgtaggccggtttgaggaccttggccagcgtggtcccggccacaccgatggtctccaagttaagcaaggtcagcaagaacgactgggcgacctgcccggccatctccgggggaaggatgcgcagcgggtccagcgacagcttggggtgggccgtgtcgacgatctggcgtctaaccccgtcgatagagttgacaaaggttacccactcccgctcatcggagttgtcggtggcaataatgcgcccgccccgggccgcgatggctgcgcacagccgcttctcggccatcgtcttgcccgcgcccatcttgccgatgaacgccaccgtgttgcctttctgatcctgagtgtcggcatgcaaatcgaggtaggccagcgactgcaacggggagcctgtgaccacagccaacgggatgccggtggtacggcccaaccggtactcaaccaccgggatagatgcggcgaacgcggaggcgtgagtcagctgacggtaggcgttaagcgaggaggagaaccggccaccgggccgggcagcccacagcaagtcctcctgacggcccacgggacgcacccacgtgaagtcaccgaacaccggatcattgacgaacgctcctgccagctcctcggtggtctcaaagtcaggagacgagacagtgacggtgataagagcctggatctcgacctcacgctcatcggcggccagctcggcgttgtagtcgacgagcacctgagcggaatgctcgatagacatgagggtcgaagcctgggtcatctcaccgccctcgacgttgtcgagctgatcgaccgtttgacggatagcccgctgatttttctgcatcgcagcgtgacgggtccgggccactccccggatcgccacgtcgaccggcacgccagtgtcgtcgatacggcccaaaaactcgtaggcaggccacgtcatcgtgcggggcaccttacccagcacgatatgggactggtagacggtctcgccggtgtcggcaccgattttgaggacgcgacgattccacgcctgagccgtccgggacatgtgggagactcgcttgtcatcctcgctggccagcaggtcggaggtcgcggcctcatcgatgaccaactcccccagcgcggcacgtccaacctcatccatgagggcgattccctcgccaggggcatcatcacgcaaccgggtcgggtggcctgacaggtgctgccgaagccagatctgttcatcaacggtgaccgggcggggttggaacgctgccggcagtttcgcaccgaattccttagcctgacggagggcccactcccgtgcgacacggccaggagcggtggtcatgagtccggcggcttcggtgattttgttgagggcggcggtccaggcggtgtgggtgcgtattttctggtcttggttgagtttgatcgataggaaccacacgcgccggcctagggattcggtttcaggctggtcgagggtggcgtcgatttcgtcggcccacacggggtgttcgctcaggtcgaggccggcggccatggcgtcgacgatttctgtggggtcggtccaggtgagggctccgttgaggcagaactcgtggcgggcgaggggcggaataggtcgcggtgagctgcggcgacggtgagggaggcgttctcggtgacgggtcgctggaggggagtgagtcgccaggtggcccagatgtcgccggtggaggtccagacgaggttgtcgaagaggaaccgttcggggatggacatcatgactccttttcggcggcggcgaggaaggcttccaggccgctgcggcgtacagcgttcccggtagggtgcaggggttttctgggggtgggttcagatttcgaatgtgggaggggtttgtggatggtatcggtgtcctcggcgagggcttggtcgagcaggcaggtggccggggtgtcggtagtctcgtccagctcgtcgatcatctcgtcgaggaggttgggggtggtggatgcggcccacacaggtgggatagccggtgcgggtcgaggcggtgtggggaggcggagtttggtttggccccagaggggtgtgtgggtcatgccggcgggagtggtggcggcgtgagtggtcacacgccaccagcccgccagccatgccagaggtgaccaggtccagtcgatgcgaccaacaacgaactgggcgagccatccggcagccagcgcgaaaatgaaaccgcggatggtcatgcccccgtcgataattttgaagcccatcattgcggcaggaactacgccgccgacagcgagcacctgatagatcgtgtagggcccgccaggaatccttcgacctgaggaatccttaccgataatgcggggctgctggcgggcctcggtgtgccactgaatatccacgatcagctcttgcccaatccttgcatcatctgtccgaagaattggatcgcgttaccttcgataagccagtgcgccataccacacacaaacagcatggagacgatcttggccaggctcataccgtgtttgaagatgttgaacgcggcaatgcccacgactacgaccatggcgacggctcgcaccgcggactgaccttcacctgccttgatcgtcgtccattcgaagaggttctgcgattccagtggcagcaggaggaattgatcgagcatgagaggttttcctttcaggaagccgaccgggatggtcccggtactgacgggctggacggcacgggtgtgccggccaggggcagaaggcgtgacggctggtcgagggaggcaacctcccagcggcctgcacggctgacaagagtcaggccgtactggctggtccgggtagtggattcgtcgccggtgggctggcatgtcacggtcaccgtgacggtaatcttctgccggtctgagggggtggggacctcgtcaggtcccaccacatgagtggttttcactgatacgcatggggctgggtcaaccgcggtgaaagcggtccctgggctgctccatctcgacaggtcagtattcccggtcagcatggcggttaggaagcctgaagaggcttgggcggccgggtcggcggtgcgaagctccgaggtgtctaaggtgggggccgaggccggtgcaggcatggggatctgtccaggtagacgcaaggcgatggccttgccgttggaatcgacgtggaccgggactgaccaggcctgtccgctcccggattggccgcccatggtgaccacggtgacctgccacaggctcggatcagacggggagacggtagcgtcataggcggtgacggtggggggcgctggaccaggtttgcggggcatgcgcgcatcggtgatcttggccgccaccaggtgttccagattgtccaagtgcccggagtcagaggtcagcagaagagtagtcacctcgaccgcggtggctgaggcgatctgagctgtgcggcggtcgtgatgggtggtgtcagtgctgacagctgtggtgggagcggatgccggggccgccgaacggaccagggcaacggggccgcatgcgactccgcacagcacgagggcaaggaagcctttggtggccatcgatccggtgtggggccagggacccacgttttcctgtgcctgttttttcttggccgaccaacggcgggacttagggttagcggatgcaccttctggggtgcatgctcgtctcaatcgcatcggtcacctccttcactggatgaagggaccaaggaggtgaccgatgtgcggtcgaacccgaaaaagttcaaacttttttctgggtctgcctcaagtacgacagaaggcctgcatcatcacggcgttgtggtagcagatcttgcgtcagcgcaaatgtatgggcctcgtaggagtagctcttaggtgggtcccggtggttgcggccagggcgagggtgtcgggtatgtgtagcgctagtcccgggttcgtggtgtgagggcttttgggtgctgacatgcactacccattgctagacgctgtgctgtggcatggctggacgtctagcagacgggttgacatcacctttaggctggcagcgcccgaggccgcaggccagaggaagcggacagcctaacgattgacgtccccctctcctttccccaacctcctgga

SEQ ID NO: 214 - DNA, 9776 bp, Propionibacterium acnes
tgtgtgggatcagctgtgccgctcccccgacatggcagacagcaccgttgcatgagaactgactgacactgtggcgccgcggaggtctcccgcggcgtccgctggggcgagtgcatgcctgtcagctcatcttttatcgtcatgtttccccttgtcagagcggtctttgcaaagtgacaacgtcaggggtcttgacgacaacatcctcgacaacatcgtggcggtggtctgtgtctcgtcagttcaacgcaccggggaaagaggcaccgctgatgttcaccaccacaaacaccctcaacgatgagtgggaccagattcgcgccactgagatcgattggcatgactgccctgaactgatgcactgcatcgacgttgatgatgtgttggccgtcattcctgccgcccccgacgccatcttgggctacctcattgcccgggctcagggcggtgacgagttggccacccgcactatcatccaagcgttcacaggcaagcttatcttgatggccacggccaccaaggtgcgccgtactaatgacggcttcaatgatctgttggcgggtctgtgggagacgatcatcacgtacccgttggatcgtcgccctgacaagatcgctgcgaacctcatcctcgacacgttgcaccgggttacccggttctggcgtgctgattcccccgatgaggaagaggctcacggtctggtgcccttccctgacactctcatcgccccagagcccgatgaggacgtcacagctagccaggccatcgccttggcggtggaccgcaactggattaccgaggacctagcccgcctcatgagccatatttactgtgacggtatgactggagctgatgcgggtcgtctgcatggctgcgctccagctacggtgcgatctcgatgccgtgatggtcgggccgtgttgcagcgcaacgccgagacgatcctggccgtctgctgatccctctcttgctcatgcctgccgccaccctacccctacctgctagaaacatagccatgtctccagcaacgcatctagcatatcttctagcaattgatctagctatgtatatagctgatgatctagctatcatatagctgtgtctccagcccaaaggacagcccaatggcatgcttgccacaggaaggtgcgtcagcctcccgaaatactggaaggagctttaccgtgcaggacatgacctcgaccagaccgattgaccgatccccgttcgaccgcactattgcggtgtggaaccacaaaggcggcacgttcaagacgtccgtcgtggcgaacctgggatacctgttcgccgccggtggcaacaaggtgctgctggtcgacatggacccccaggccaatctcgacattgacttcggtatacccgcgggagaacgtgaacggggcatgggattagccgaggcgctacgtgaggggacggcccttcccccaccgcagcatctcagcgaaaaccttcacctggtcagtggcggcgctgctctcaacgagttcaccgaccccgcatccttagcggccatcctcgaccgagtcaccaccgcacgctacgacctgctagctcaggcccttgccccgctggcctgggactatgacctcatcttcatcgactccgggccggcacaaactctgctgtcccagaccatccttggagtagcccgctggctggtagtgcccacccgcaccgataacgcctcaatcactggcctcgtcgacgttcaagacgccatcgacggggttgcctcctgcaaccctgaccttcaactactcggcgttgtcctagccggcgtgggggcccgggccacccggatcgccgcagataaacgccacgccatcgacacagtgctgggggcaggaaccgttttcgatgcggtcatccactactccgagaaggtgtccgtgctcgcacgccagcagggcaagaccgtcgccgagctagccaacgagtaccacaacacccagcccgcctacacctacctagctaaaggccagaacatccccaacgtcgccaaggcagccgtcagcatcgaaactgattatctgaggctggccaccgagatcagcgaccgcatgttcaccagcgacgagcaggagcctgatcatgactgacgatccgactccatccgagcagaacaaccccaccagcgacgacatgcgcttggccgaagaatgggccaacagcggccgcacagtgggagccctgccgcgccgtcaacggcctcagcgacccacaccccgcaccaccagccaaccccctgtctcgtcccctgacacaccggctccgaaaaaaccccagaagacccccaccagccagcctggccgtcaacggatcaacgtcaccgtctacgttgtgcccgaactccatgagcggctgcgctcccgatcggcggcgacgggggtgacggtctcggatctggtggtgcatgcgttagcgttcgtcgccgatcatgcgggggaggcgatcgccgatgatctgcgcgtcgagacgggccccggcatgggggccggactgttcgatgtgaccccatcgcggccagtaggggtcgccaaaacccagctgggggtgcgaatgacccgccacaacaaggatggtttggaccagctgacccggacgagtggagcccgtgaccgcagccatcttgtgtctgtcgccgtgcgcgactatctcgactccaaccctgtaaagaaaggccgacatgtccgctgatgaaactcctgccgcccggggtgggcgacgctttgatacgaccgtcaagcccaggcgccgtcccatgcttatcgccgccggtatcgccatcgtgatagtcggcgcgctcctcatcactcagttgattcgctccgcccaaaccgagcatcgcgtgctggaagtccacgccgatgtggctcgcggcgaggtcatccgtgacaccgatctggtatcggtgactgtcggccaggtcgacaacgtatcaacggttcccgcagaccagctcgactcactggtcggcaaacgcgccacggcagatcttcgagccggatcactcttgcctgctggggctatcggcccggccgatgtcgttccagctccgggcaagtcgctggtcgggctgaagctagccgccggacagatccctatcggagaccttgctgccgggacgaagctgcgcctgatccagacgtcggcacccagcggctcatccaccaccactgatagcagcaccaataccgatggccagtcgtgggaggcaacaatggcgaccggcaccaaaaagaccgagcaggtcaccttgatcaacgccgaagtgaactcgcgtgatgccgcccggatcgcccaactgacgtcacagggccgtatcgccgtagtgaaggatccgatccgatgagcaccattgttttgaccagcgtctcgggagccccaggggtcaccacgacagcgatcgggctgggcagggtctggccacaatcgagcctggtcgtcgaggatgacacccaccacgccatgctggcgggctacctgcgagcctcccagcacgccgaaccgaacctggccgcagtggcgaacctgacgtcgactccaaccaacgcccaaacggtgtgggaatctatcgccagacccctacccaccgatgacccagtcggcgggctgcgacgcaaaggcatcctcggcccgcccacgccgtggtctcgcgcaggcatcgacccccgatggggattcatgctggccctgtggcggcaactggaggaggctggcatcgacaccatcatcgatttgggtcgcctagccacaccactgacctcaacgccacacctgatcgccgcacccatcgtcgaggacgccgacatgatcttggtgatgatcgaggcgacactacgcgacatcgccggcgcccgcacgatggtggagggactcgctgagcagatgaacttggccggcgcctaccgacgtctcggactgcttgtccaccgtggcggccaggcccgcggcgtcgccgagttcaatgacaaggagatcacctcggcgttacgactcccggtcatcggggccattacccacgacccggccggagccgcccaactctccgacggggtcgggcagcggttcgacaagtcacgtctggcccactcactatcaaaggtggcggccagcctcgtcgatgccataaacaagcgccacgctgatgacgaggaggatctgtgatggccagttttgctgataatccgttcgacaagctgcgctcccaggatgcggcaagagcttcggtagagcaggagcctgatgccggattagcgtcggagttgttttcgacgtcgtcggggtgggccagctctcagcaggtgtcccaagctcaaccggtgatgacccgttcggagaacgtggattggccggttgtcgcggagctagccagtacggccactgatgaggttgaggctgagatcagcaggtggagttccactcatgatggggtggcgacgctagacattcgccaggccatcgcggagcctgctattgcctcggcggtgtctacgtatgctgaccgacgccagatcgatgtaggggagacctggcctgatctggtacgccagcgataccgcaaggctgtgtgggatcagctgttcgggatggggcggttgcagccgctgttcgaaatcagcgacgccgaaaacatcatcgtggtgggtaaccatgaggtggttgtcgaccacaacgatggttcccggtcaacgctgccgccggtggccgactcggatgccgagctggaatcccagatcgcccggatggcgaggaatgcgaccccgcggcgagccttcgacgccgatcacaccgatgtgacgatcatgcaccaacagaagttccgtatccacgcgatctcttcggaggtgtcgttgcaaccgtcggtggtcatccgccaacatttgctcacccaaatcagtctgggggacctgtcccagcggggaatgatgccggtggaagtggcccggttcctcgatgaggcggtacaagctggcaagtccatcgtggtcgccggcgagcagggggcaggcaagacgacgtttttacgagcgttgatccacgccattccgatgcgggagcggttcgccacgttggagaccgatcaggagttgttcgctcatctgatgcctggccgggaaaacacgctggtgctgttcgcccgtgatggtaacggcgaggtggatccggcgactggcacccagcacggcgctatcgagatcgcccagctgattcctcctagcctgcgccaggcgttaactagggtcattgtcggtgaggtgcgcggcaatgaggcttcggccatgttccaggctatgcagtcggggactggcactatgagcagtatccactccccgcgagcctctgaggtgccgtcccggctagcccaaatgatttcgatgggcccggtctacgatctggatcaggccatgctgcagatcggtcattcgatcgactacatcgtctttgttcgtaagcgtgacctgcctgatgggagccggctgcgatttgttgagcagatccgttcagtctcgcctggtgattcgacaactcccagtcttggcgaggtgtacacggctgactcgtggacaggccagccgcttacgccactcatgcctggttcggccgccgacgagctgtctcacttcgcccgagacctggattactgcgaggcccactcatgaacactcccgcactaaccagcgccctcatcgtgaccgggttggggctgatcctggccatcgacgggctggtcccggcgccgcctcgacctggtgccccgctgagcccggcccagaggtgggctcggctcacccaccgtcccacaggagcggccgggcgtcgccgggatttgcgttgggggttggctgttctcgtcggcgtcgtgctgtttgtgctcaccgggtgggtggctgcgctggcgttgggccccatcattgtgttgttggcccccaccctgctgggggcggccccaccgaccgatattccgctgatggaggcgttggatcggtgggtgcgtcaggtcgctgcggtgctgccacaggggcgagacatcatcacagcggtgcggatctcacggccgcgggccccgaagctgatcgccgggtcggtggatcaactggtgtcccggttggatggccgtatggagccgagggaggcgttccagcggatggccgacgagctggactcggctgaggctgacgcggtgctggcctcactagcgttggcggccactcatccgcggggagcctcgacaacgttgaaggctattgctggcaacatccaacagcggttgaaagtgctgcggcaggtggaggctgagcggtctaagccgcgtaactcggtgcgccagatcacactggtcacgatcgccatgttcggggggctgctcgtgatcggacggtcgtttctggccccgctggcgacccctcccggtcaggtgctggtggccgtggcggtggtcatgtatgtcatcgcactagtgcagatgtatcggatggcgcggccccgtcgacgcacccggatcatggtcaggaggacccgatgaccattactgctttgtccctgctggccggggccatcgtcactgtcggactgctggtcatcgtggcagcgttccgcccagccccaggccctgacctggttgccgctctggaggtggtgtcgggtcgcacctcaagcgtcgccgagaacgtcgaccagacccggatcgggcggataggtcgcagcgtgacccgcacattccatgtgtcggtgtccccggccatgcgggccgcactgcgactccaaggcacgacccccgaagcgttctacggtcgacgcctgatctgcgcactgatcggggcgatcctgccgtggctgctcaacgcggtagccatcgcggtaggggcgaattccccgaacctactcatcccttcggcgctgtgtgtggcgttagctggcgctggatggatgctgccggcagcacggttgaaggctgcggccgggcccaccaacgatgactcgttcgaagcgctgctggtattcatcgatttggtcgtgctggaacggctcgccaacgaaacctccgtcgacgcgctcaccaatgcggcaaacatgtcggactcgccgctattcgtccagatccgtcaagtcctcaaccgtgcctccctggaaaacgtcgacccgtggaacgggctagaccggctagccgaggacatcaaactgcccgaactcaccgatgtggtctccatcgcccgcctccaaaacgaaggcgcctccctcgtcgacagtttccgggcccgagtcgccgagttgcgcgacgcctacctgctgcgcctgcaacaagaatccaccgccatcacccagcggcttggtttgtggacgatcctgcaagccggctcggtcatgctcatcttgctgggggcggccgccctcacactcatcacagccggataaaccgacatcgtgtcgagcccccatatgggccgcgaacctttcataatgatgcctgtaagcaccacaatattgatcacaacctaacaatgaaggagaaatcatgatgaccgatctcgacctggctaaaaaacagatcacctggctggcggcgcacctgcgttcccggatcgttgacgagcgtggcggtggtagctctaccgtggagacactgatttggattggtgtcatcgtggcgctggtgattggtgtgggcgtcggggtgacggcctatatcaggtcgaagatgcctcactgacgacgatgcgtagcaggttcacaactgatcagcgtggcggtggtagcgcgtcggtggggatgctcctgctgatgcctgcgatcatgctgctggcattcggtgggatcgaggtcgggatgtggtgtcacgcccatcagtcgaccatcgcggcagcccaaagcgccgcggaggctcagcgtgtcgtccatccggtcccggggtcggcacaggaggcagcctcgcagatcactagtcatggcggggtgcgtgatacccggatatcggtcagtgatgacggggccactgtcacggtgaccgtctcaggtcgggccccatcgatgctggggctgcatcttccggctgtgtcgtcgacagcgtcgatgcccaaggagcgcctgtcgtgaggcgaagtgagcgcggtggagcaagtctaagcgtcgaggtgctcatgtgggcgccgatcgcgctggtgatcatcgggtttgttgtgggtatcggccggatgtcgatggcccaggacgcggtgaatggcgcggcgggtgctgcggcccgtgcggcgtcgttggagcgtgatggacagtcggctcagtctgcggcgcagcaggcggcgtcggcgaacctgtcgtccggtgggctggcatgtgcgccgagtgtgagcgtggacacgtcagtgtttgcccgtcctgccgggcaggcgggcacggttcacgccacggtcacgtgtgtcacctcgctgggtcttgggttcgggtcccggacggtgcacgcaacggggtctgccccggtagacacctatcgggaaaggagaggctgagatggcccgtgatgagcgtggtggcggctcggtgtcggtgtggatgctgctcatggtgccggtgattctggtcatggccggcctggtttttgacgggtcccgtcagatatcggcaacccaggcggcccaggacgcggcggttgcggcatcccgcgccggaactgatgcggcagcgacaccgcagcttgctggccacgacggggcggccgtagcagtccaagcggcccgccaggcactatctgctgccgggggggacgggtcggtgcaggaggacgggtcgaccatcacggtgaccacgtctcaaagtcggccgacagtgttcctgtcagcgatcggaatcagccaggtaagggggcatgggcaggcccatgctcagcttgtgggaccgggagaacgcccatgacagtgatacgtcgtatcggtgccctggtggcactgctggtggtgatagccggcttaccggccgggctcgtggccgcaggcgccccgctagtaccctcgggcctgtcatgggcccatgtgcggcatctgttggttaccccagacatgaccgggtcggtgctggtgtggctggtcagcctcatcggctggatcgggtgggcatggttcgccctggccgtcgcagccgaagcggtgacgatgctctcagggcagcggctgcactggcacatgcccggccctcgcctagtgcgccgagtggcagccggtcttctcattgccgcgttcgcggccgcaccggcagccacaagcacggctcacgccgccgaggccacccatgtggcggtcgccgcccaggctggaccggcacacgcggcccccgcccaggacagccccgtcaccacctctcaggccccggacgcctccaccactccgaaaatctggaagacctacacggtgcgggccaacgactacctgtggaagatcgccgagcactactacggtgacggcgcccaattccgtcgtatcgccgaagcctccggtatcgacccgcactcagagctgaaagtcggccagaaactgatcctgccggttcccgagaacacggccgcagttcattcggttaaagcgggggagtatctgtgggagatcgccgagcactactacggtgacggcgcccagtaccataaaatcgctgaagcttccggtatcgatgcccattccgatctagccgtgggccaaaaactcgtcatccccgggcccctccgccacgacgccacgccgccacaccactcggcgtcgacccacgcgaag

SEQ ID NO: 215 - DNA, 2238 bp, Propionibacterium acnes
gacgccggccaccccaactactccgacccacacggtgaccccagctccggcctctgccggccactcgaccagcgacgagcacccactccatacggataccgccgcagcggacaaggccagcaacgaggacgccctgtccccaatccaggtgggtttgaccgccagcgtcggactggtgctggtcgccggactgatcaccaccctcaaccgccgctaccggacccggttcacccgccagccccgcggcaaggccatgaccctgcccagcccggacgcccaaactgccgagatagcgctgcgcagcaccggggcgactgacactctgacgatcacctgcctcgaccaggcgctccgcgcgatcggcgcatggtgccaccactgcgggcacccgctgccacccctgctggccgcccgcgtcgatgacgaccggatcgacctgctgctatcccaggcggcccccgaccatcccgaggcggtggagctggccgccgacggatcggtgtggaccctcaccgccgaccggatcgacgacctgctagcccacaccgatgacaaccaagcggctccgtggccgtctctggtcacactgggacgcgacgacgacggcgcccacatcctcatcgacttggaagccgcaggaaccttgcacctgatcgccgatgacgaccaggtcgacgcggccctcgccgcgatcgccgtggaactggccacctgcgactggtccgacgaagtcaacgtcaccctcgtcggccaggtgtgcccgggcctagaagacgcactagagtctccgaccctgacccgcgccaccgacgtggacaccctcctcaccaccctagaagctcgcgccgacgaccagcgacacatcctcaccgaaggaaaccccctcgccgctcaccgagccgaccccgccatctccgacgggttcgacgccgaagtgatcctcctcgacaccgaactcaccgaagaccaccgcaaccgcctcgccagcctcgtcgaggctcttccccgcgtgtcagtcgccgcggtaacaaccagccccaccagcccagacgaatggtccctcaccctgacaggtgacccactagccgccgacctggctcccctcggctggcacatccacccccaaaccctctcccccgacctgtacaaccgcatggttgaactactcgccaactccgccgccgcagactacgaacccgccagctggtggaaccacgacgccgacgacgagcccaccaccgaccccaccaacgaggaagaatctaccccgagcaggcgagcccgcccgaatatccgcctgaccaccctgaccggcggcatcgacctatccagcgtcgacatcgacgacatcatcgacgaagccaaccaggccctcgacaacaccgaccagaccaccaaccaggttcgcgtcgacaccgaccaacccggcaccgacacccccttccccatcgacgacatcgacccgctgagctccgaccacccggtcctatccatcatcggccaccccgacatcacaggtgccactggaaccgttgggcgctccccgtggcgctgccaacagttggccctctacatcgctgagcatccgggagcatcgggggcgactatcgccgatgatttggggctatcagcgtcgacggtgcgctcgattgctacacacctgcgacactggttgggagccgacgatgccggggtggcttacatgccggcggcgacgcgcggctaccggctcgatgagcggatcgtcacagatgtggacctgatcgacgctgctgtggccggggcaggcattaacaccgctgagacggccacactggtggccattttgaagctgggccgcggacgggtcttcgctggggttcctgactcggaacttcgccagttcagggcgtcgatgtaccacgtggaggcccgcatcgttgatgcggctcttcaggtgacggatcgggctctggaagccggggacttggggctggcccggtgggcgttgacccaagggctactggtgtctcccgatcatgaggacctggtcgccggttgtctgcgcaccgagtaccaggccggcaacatggacaaggtttccgagctggtcgatcacctgtcggctaccgcacgacgcctgggcgtcgatttgagcgccgacaccacccggatcatcgatacggtcacccacgccgacaggagagcgtcatgatctcccctgcactcatctccgtcaggaaggttcctatgcaccat

SEQ ID NO: 216 - DNA, 10907 bp, Propionibacterium acnes
ggcttcctgtgcgccgagcatgagggtgccagaatcctcgccagccgattcccagtcgacgatgacctggtcgccgtcaacgctggattcggcgatggtcacccattgcccgtccatgtcgatgagcatcccggcggccagctctgtggcggcaaccgggtgggctgggctgtagaggaggtcgatgtcgcgggcagggtcgtcgggttcttcggttacctcgggtggggtcgatctggctgtctcggtgtcgtcggccaggtcggctcccaggatgcgttcccattcggggctggttttcttgcccgctgaggccatcgtctcgtcgatctgttcgtcagtgggccacacaaatttctttttggtccaggtcgtggtgtcgggtcgcagctgatccagcagttccaggtcttgcggggagtgggccttgcgggggtcgggggtgtagaagaattggacttccttgggggctgattcgccggataggtaggtgccgcggccgcgtttgccgaacgggatgcccacgccgacgtgttcggagccgaacatcatgcgggctccgtcagcggacaggggtccggtggcggcacgcccggagaagttgtctcggatttcgccgcccaggaactcggcgtcggggcgttgggtccccagatcgacgtggatacggcaggcggctgccatgcgcagcagggagccgatccagccgaaaacggggcattctccgggcatcccagagaccttgatcgttgaccaccagtttttcgcgttgccgtagaactggcggtactcgtcgatgaggaccagcacgcgggtgaagtcggtctcgcgggccccttcttcttcgatgcggcggtagcggtcctccatgagagaccacagccagtggatgagggcgacctggtcggggacggtagtggcgaccatctcgatgttgggccactcccgcaggcccaggtactcgatgcgtttagggtcgatgacgaagacgcgccagttgcggcgggcaccctcgacggcgtcgccgatcatggacaccgtttttccggtacgggtgcggccggccttgagctggtgggccatgacaccggagatgtcccagaaacaggtgttgccgtcctcgtcgacggcctgggggattttctcccagtctggggagtctgggcccggaagggccacgggtcggggcaccatcgagggcagggggtggcggcgggtgacggtgatggtgtcgtgttccaggtcgaagtcgctgcgccactggccgagcatcatcgccgaggtcaccgcggccaggcgcaattggatgttcgggctggacaaatgggcgccacgttggtggtgaatggtgaagccgtccaggttcccccgatcggttttccaggaatcgacggtgaccgccgacccatagatctgagtggctacttctttagcccgttccttgtctcggtccagatcggttttgtcagggtcaggggtcggggcgcggtattgcaggacgaaccggccggccgggatcgttgcggatgtcaccgtgaactctgccggcgaccaggcagccgcggccgcctgggtgagggccattggcatggtctcgacggcagcctcctcgggggggatggtgagggtcaggcgtcgcggatgcgtcttcttgcgattccatgtgactttctgcctcaccggcaccttcgccgccgactgaatggctaggcgagctgattcggcagtttcggtacgccggccagcgcgtagcgcccgtcgtgcgtgaaggctgcccaccacagcacagcccatacacggcagccaccagcgcggatcagcggctgctgcatagcccccggtagctagtaccgcacctgaccagccggccgcgatacttttccacgccggtttcgcgccaccaggaccagcgttatggacggtctgcttcgaggctgcggagggacgagacagcggagtgctggtcatgccgcggcctccttgtggcaggtcatttcacaggcatgccggccagcgatgatgccgtggcgcaccgccccggtagccgcatagaccgcgcacaactcaaacacggggcacccatcgcaggccgccgggttcatgctttctttgtcccacgatggtgggtcatcggtgcacggcacggccaggccatcctgttgagcggcgctgatagcggtgaataggcgcagctgggcgcgaacttggtctggggtcaggttgacggtgcgggctacacgcatggggttccttcctcttcaccagtgaaggttccctagacccggccgatgtgcggagggatttcagtgttttatcgaggtgacaagccagccggtctgcgctgcgggttcaggtaccagggtcagatgcagcatggtgtggtcggctaggggcacggcgaccaggggcccgtcggcgctcgccccggtgagggtgggagttccggccacggtggtggcgggaatctggttgggtttcgcggccatcagggagcccatgagggtcggggcggcgatctggacgagggcgactttgcgggcggcgggatcgcgggtcaaccagccgcgggtgaaggtgagcgcagccgacgtgatatcggggctcagcggggctggtgtggcggcggggtgggccgttgaggagggccatacgcgcggtagcgctggcgacatcgagcgggtcggagtggggtcaggtgtggggcttagggtccgatgtggcgatggggctaccgccccggtggtgggagacgagactggttgggggtggtgttgagggcgtgggatcagggtgaaggcagccaaactggccgggatgaggatgacggccgcgccgacacttcggagcgaggtcatgtgacgatccttcggtagctcgacgggttgccgtagatcttttccacgttgatgccactatgtgggttgtcggcgctaaccatttggcctccaccgatgtagacggccacgtggtgggcagggcttccccagaggatgaggtcgccgactttgagctggtcacgggccaccgcggtgccgactttctgctggtcggcggcggtgcggggaaggctaatgccgatacgccggtacagcgccgaggtcaggcctgagcagtcgtagccgccatcggctttgccgttgccaccccacacgtaggcgtaggagttgttgtcggcgatcgatttggcccatgccacggcttcggccaggttcttcgacacaccggtctcgttagcggccccggtggcacagttgtttgacaggtgccctgtagtagtggatcccactatttgtttggccatggtttcccatttggcgtaggcatcgggcagggctgagccttgcactgcctgagctgcctgcgtcagcggcatcttctgccagtcagcgatgtcgactaaaccgggaatgtggaatccagggccgccggccgatccggggccagcgtaggtgatggtgtggcctttcaagaacgcctcggtggcgtaggcatcattgttgacctgatccagagtcccgtaccagcccggcaggatgcgctgctgaaaggggccggcgtcaccgtcaccgttagccttcgctgaggtagggtcggccccaagatctgattcttgtttggcggtcatgatagcgatgaccgctgcctgggtaggcagtttgtcacgctggaccacagtgacgatggtggtcacgagctgcttctgcctggccgtgaggcctccggcacccacagtgcctccggtgacggtacccacgcaagcatccccgccgacactgccaccgccgccgccagagttgtcgtcgagggccccagagcctactgacagcagcggcacaatgatcacggtcgcgggcaagaccgccaggcccgccagcatcagcactgctgcactcaccacggcgatcacgtgagatgctttcaacgctgcccacctttcgctggtttgagggggcgacgcctgctggtacgcacaggcttggttggtccagtccgccgttggttggcaggcctgggtttgatcggcttgctgggacccggtttgggctccggagtcttaggctccggcttcacatgcctaggcacttcggctgcggtgggaggagtcagcacgtggcgtaccggcttggtgaccttctgggcacccgaaacaaccggcttagacaccaccttggcacctttgaccaccggtgcggctgccttcgcgccggccttcttgactgcacgatgcgctttgatagccccggcctcggcccggccaaccctgctagcagtagcatcgagggctctgtggcccgtcgttgccctcaccggtgcatccttgccctggcgggtctgcttagcgatcgccgacatgccgcctcgcaatgccgaaacatgattgtgggcgtgggcgatcgccgacatgccggccgtcgcgatttttgactggccctgcggggcccctgccccagcacgaatctgctggtaagccgccgacgtgccacgagcacccgccgccattcgcgccaccttcgcagccctagtcactcccgtcgacacgccacccgtggctaccgcagcagcacccgagaccacagtcgaggccatccgccttcgacccaatccggtgagcttgcgaccaccgctgcgcaccatccggcgagcaccccgcccagcccactggccaatcgccgacgccccttcggaacgcttgctgcgcatccaatcgttgatcttgtccctcagccccttctcgcccttgtgacgacgccacatggacatcaagaacccgataatccccacgagctcgagcatgttgacaaccatgaccttgatggcgacatcaccgtcagaggcgaaaaccgacttgatgatgagcatgaccacacccaacatcaccatcgacccgacaatgccgatcatcgagtacaagatcgaacacagatcccggatgagcggatctgtgcggccagggatagcccgcaacacgttgagcatcgacatgaacgccgaccacaccaacttgcacacgtagaaccagcacatgcccgcgaacaccagcaggaccacagccaaacccgccaccgtcgacgagtaaaagaagaaccccaccaaccacgaaccatccgcaatatcgccggcgtaatccgacaacccctcatcacagtcaccaaggtcgtcgcgagcatccgagacgtcatcgtaagggccacccttgagcacctcgatgtacttgtcgtggcacttcgcatcaataatgcggccatagttgagctgctgatgaaccggcgccacgaacgagtccacaatgatcgccgacagcttcggatccttcgagtctcccgtcgaggtcatgtcatcaggaatctcgacctcaccagcggtcgccgtcgcaggatcaaccgaactggtaatcatatgagacagcgccacaccgaactgctgggtgcgagccagcggagtagccaacgtcgtcgtatcgcctgcgaacttcgccaccggggccgccaagaaacccaacgccagcgccgcagcaatcgccgcacgcgcacccgtagcccacgcccctgccgtacgtcccctcatcatcttgacgaccacgcccacaccggcgcacgtcgtcagcaacgtcaacaccgttccaccccagctgtccgctcccagcggggccaaaaccttgtcgtggatgtcgttctgtaaccccaccagcggtccggtaatccacccgacccagctcatcgccacggtccagtccaacaaccggcacaacagggcaatgaccatcaggtacgtgttccaacacatgccaataatggaggcccacatagccttcagcggggccgtaacgccaccatcgtccatcgacatctggtactgaaacaagtgaataccgttggagtcagtcacattgaaaccgtcacccatccagcccagccccggacccgatgccatggcaggcacactgctcagcgccaccaccagaaccagcgtggtgacgatgatacggaaccgccgctccccggccccggggcggcgtggatgacggctcacgctgtctcctggtcgtgctcgggcgggttggagctggcggcttcgcggtggggagcgtaggcaggtctcagtagtcgaatttcaccgacgttgccgtgttggtcggcgtacaggccacaaccggggcctccggggttgagggcaatcttgaccaggtcagcgaactcttcaggggacgttttagggtccacgcccaggaactcgacacctttctgggcgaggttgatgttgtcgcacagcaacacgatgcgatgctgaatgaggttgcggacggtctcgttggggtaatcggcctcggggtcgtgggagccggtgataagccaggcattggctcggcgggattcgcgcacgtactcgtcaatggcgtgggaggcttccggcgaggacgacatgtgatgaaactcgtcaacaatgaaagcggcgtcgcgggcccggtcgctgaagcacaccaggcgagccagacgggcaatgagcgcgtagagggctcggccaaacaccttgtgcgggggcagctgccgaaacagatgttctgacagcatctcctcggcgttaggaagagcgatgccacaagtgccaatgatgaggatgtcggcactcaggtcggcgggaggaaggtccgggtcaaagatggccgaagctagggaggccgagttctcgatgtcagcgaacacggcaatcctgtcagcgatcgcggtggcctcgggaaggtcgcactcctcggccaggtggcgggccaaacgcccacacgaggtgatctggtggtcacgcatgtaggccggtttgaggaccttggccagcgtggtcccggccacaccgatggtctccaagttaagcaaggtcagcaagaacgactgggcgacctgcccggccatctccgggggaaggatgcgcagcgggtccagcgacagcttggggtgggccgtgtcgacgatctggcgtctaaccccgtcgatagagttgacaaaggttacccactcccgctcatcggagttgtcggtggcaataatgcgcccgccccgggccgcgatggctgcgcacagccgcttctcggccatcgtcttgcccgcgcccatcttgccgatgaacgccaccgtgttgcctttctgatcctgagtgtcggcatgcaaatcgaggtaggccagcgactgcaacggggagcctgtgaccacagccaacgggatgccggtggtacggcccaaccggtactcaaccaccgggatagatgcggcgaacgcggaggcgtgagtcagctgacggtaggcgttaagcgaggaggagaaccggccaccgggccgggcagcccacagcaagtcctcctgacggcccacgggacgcacccacgtgaagtcaccgaacaccggatcattgacgaacgctcctgccagctcctcggtggtctcaaagtcaggagacgagacagtgacggtgataagagcctggatctcgacctcacgctcatcggcggccagctcggcgttgtagtcgacgagcacctgagcggaatgctcgatagacatgagggtcgaagcctgggtcatctcaccgccctcgacgttgtcgagctgatcgaccgtttgacggatagcccgctgatttttctgcatcgcagcgtgacgggtccgggccactccccggatcgccacgtcgaccggcacgccagtgtcgtcgatacggcccaaaaactcgtaggcaggccacgtcatcgtgcggggcaccttacccagcacgatatgggactggtagacggtctcgccggtgtcggcaccgattttgaggacgcgacgattccacgcctgagccgtccgggacatgtgggagactcgcttgtcatcctcgctggccagcaggtcggaggtcgcggcctcatcgatgaccaactcccccagcgcggcacgtccaacctcatccatgagggcgattccctcgccaggggcatcatcacgcaaccgggtcgggtggcctgacaggtgctgccgaagccagatctgttcatcaacggtgaccgggcggggttggaacgctgccggcagtttcgcaccgaattccttagcctgacggagggcccactcccgtgcgacacggccaggagcggtggtcatgagtccggcggcttcggtgattttgttgagggcggcggtccaggcggtgtgggtgcgtattttctggtcttggttgagtttgatcgataggaaccacacgcgccggcctagggattcggtttcaggctggtcgagggtggcgtcgatttcgtcggcccacacggggtgttcgctcaggtcgaggccggcggccatggcgtcgacgatttctgtggggtcggtccaggtgagggctccgttgaggcagaactcgtggcgggcgaggtggcggaataggtcgcggtgagctgcggcgacggtgagggaggcgttctcggtgacgggtcgctggaggggagtgagtcgccaggtggcccagatgtcgccggtggaggtccagacgaggttgtcgaagaggaaccgttcggggatggacatcatgactccttttcggcggcggcgaggaaggcttccaggccgctgcggcgtacagcgttcccggtagggtgcaggggttttctgggggtgggttcagatttcgaatgtgggaggggtttgtggatggtatcggtgtcctcggcgagggcttggtcgagcaggcaggtggccggggtgtcggtagtctcgtccagctcgtcgatcatctcgtcgaggaggttgggggtggtggatgcggcccacacaggtgggatagccggtgcgggtcgaggcggtgtggggaggcggagtttggtttggccccagaggggtgtgtgggtcatgccggcgggagtggtggcggcgtgagtggtcacacgccaccagcccgccagccatgccagaggtgaccaggtccagtcgatgcgaccaacaacgaactgggcgagccatccggcagccagcgcgaaaatgaaaccgcggatggtcatgcccccgtcgataattttgaagcccatcattgcggcaggaactacgccgccgacagcgagcacctgatagatcgtgtagggcccgccaggaatccttcgacctgaggaatccttaccgataatgcggggctgctggcgggcctcggtgtgccactgaatatccacgatcagctcttgcccaatccttgcatcatctgtccgaagaattggatcgcgttaccttcgataagccagtgcgccataccacacacaaacagcatggagacgatcttggccaggctcataccgtgtttgaagatgttgaacgcggcaatgcccacgactacgaccatggcgacggctcgcaccgcggactgaccttcacctgccttgatcgtcgtccattcgaagaggttctgcgattccagtggcagcaggaggaattgatcgagcatgagaggttttcctttcaggaagccgaccgggatggtcccggtactgacgggctggacggcacgggtgtgccggccaggggcagaaggcgtgacggctggtcgagggaggcaacctcccagcggcctgcacggctgacaagagtcaggccgtactggctggtccgggtagtggattcgtcgccggtgggctggcatgtcacggtcaccgtgacggtaatcttctgccggtctgagggggtggggacctcgtcaggtcccaccacatgagtggttttcactgatacgcatggggctgggtcaaccgcggtgaaagcggtccctgggctgctccatctcgacaggtcagtattcccggtcagcatggcggttaggaagcctgaagaggcttgggcggccgggtcggcggtgcgaagctccgaggtgtctagggtgggggccgaggccggtgcaggcatggggatctgtccaggtagacgcaaggcgatggccttgccgttggaatcgacgtggaccgggactgaccaggcctgtccgctcccggattggccgcccatggtgaccacggtgacctgccacaggctcggatcagacggggagacggtagcgtcataggcggtgacggtggtgggcgctggaccaggtttgcggggcatgcgcgcatcggtgatcttggccgccaccaggtgttccagattgtccaagtgcccggagtcagaggtcagcagaagagtagtcacctcgaccgcggtggctgaggcgatctgagctgtgcggcggtcgtgatgggtggtgtcagtgctgacagctgtggtgggagcggatgccggggccgccgaacggaccagggcaacggggccgcatgcgactccgcacagcacgagggcaaggaagcctttggtggccatcgatccggtgtggggccagggacccacgttttcctgtgcctgttttttcttggccgaccaacggcgggacttagggttagcggatgcaccttctggggtgcatgctcgtctcaatcgcatcggtcacctccttcactggatgaagggaccaaggaggtgaccgatgtgcggtcgaacccgaaaaagttcaaacttttttctgggtctgcctcaagtacgacagaaggcctgcatcatcacggcgttgtggtagcagatcttgcgtcagcgcaaatgtatgggcctcgtaggagtagctcttaggtgggtcccggtggttgcggccagggcgagggtgtcgggtatgtgtagcgctagtcccgggttcgtggtgtgagggcttttgggtgctgacatgcactacccattgctagacgctgtgctgtggcatggctggacgtctagcagacgggttgacatcacctttaggctggcagcgcccgaggccgcaggccagaggaagcggacagcctaacgattgacgtccccctctcctttccccaacctcctgga

SEQ ID NO: 217 - DNA, 9469 bp, Propionibacterium acnes
tgtgtgggatcagctgtgccgctcccccgacatggcagacagcaccgttgcatgagaactgactgacactgtggcgccgcggaggtctcccgcggcgtccgctggggcgagtgcatgcctgtcagctcatcttttatcgtcatgtttccccttgtcagagcggtctttgcaaagtgacaacgtcaggggtcttgacgacaacatcctcgacaacatcgtggcggtggtctgtgtctcgtcagttcaacgcaccggggaaagaggcaccgctgatgttcaccaccacaaacaccctcaacgatgagtgggaccagattcgcgccactgagatcgattggcatgactgccctgaactgatgcactgcatcgacgttgatgatgtgttggccgtcattcctgccgcccccgacgccatcttgggctacctcattgcccgggctcagggcggtgacgagttggccacccgcactatcatccaagcgttcacaggcaagcttatcttgatggccacggccaccaaggtgcgccgtactaatgacggcttcaatgatctgttggcgggtctgtgggagacgatcatcacgtacccgttggatcgtcgccctgacaagatcgctgcgaacctcatcctcgacacgttgcaccgggttacccggttctggcgtgctgattcccccgatgaggaagaggctcacggtctggtgcccttccctgacactctcatcgccccagagcccgatgaggacgtcacagctagccaggccatcgccttggcggtggaccgcaactggattaccgaggacctagcccgcctcatgagccatatttactgtgacggtatgactggagctgatgcgggtcgtctgcatggctgcgctccagctacggtgcgatctcgatgccgtgatggtcgggccgtgttgcagcgcaacgccgagacgatcctggccgtctgctgatccctctcttgctcatgcctgccgccaccctacccctacctgctagaaacatagccatgtctccagcaacgcatctagcatatcttctagcaattgatctagctatgtatatagctgatgatctagctatcatatagctgtgtctccagcccaaaggacagcccaatggcatgcttgccacaggaaggtgcgtcagcctcccgaaatactggaaggagctttaccgtgcaggacatgacctcgaccagaccgattgaccgatccccgttcgaccgcactattgcggtgtggaaccacaaaggcggcacgttcaagacgtccgtcgtggcgaacctgggatacctgttcgccgccggtggcaacaaggtgctgctggtcgacatggacccccaggccaatctcgacattgacttcggtatacccgcgggagaacgtgaacggggcatgggattagccgaggcgctacgtgaggggacggcccttcccccaccgcagcatctcagcgaaaaccttcacctggtcagtggcggcgctgctctcaacgagttcaccgaccccgcatccttagcggccatcctcgaccgagtcaccaccgcacgctacgacctgctagctcaggcccttgccccgctggcctgggactatgacctcatcttcatcgactccgggccggcacaaactctgctgtcccagaccatccttggagtagcccgctggctggtagtgcccacccgcaccgataacgcctcaatcactggcctcgtcgacgttcaagacgccatcgacggggttgcctcctgcaaccctgaccttcaactactcggcgttgtcctagccggcgtgggggcccgggccacccggatcgccgcagataaacgccacgccatcgacacagtgctgggggcaggaaccgttttcgatgcggtcatccactactccgagaaggtgtccgtgctcgcacgccagcagggcaagaccgtcgccgagctagccaacgagtaccacaacacccagcccgcctacacctacctagctaaaggccagaacatccccaacgtcgccaaggcagccgtcagcatcgaaactgattatctgaggctggccaccgagatcagcgaccgcatgttcaccagcgacgagcaggagcctgatcatgactgacgatccgactccatccgagcagaacaaccccaccagcgacgacatgcgcttggccgaagaatgggccaacagcggccgcacagtgggagccctgccgcgccgtcaacggcctcagcgacccacaccccgcaccaccagccaaccccctgtctcgtcccctgacacaccggctccgaaaaaaccccagaagacccccaccagccagcctggccgtcaacggatcaacgtcaccgtctacgttgtgcccgaactccatgagcggctgcgctcccgatcggcggcgacgggggtgacggtctcggatctggtggtgcatgcgttagcgttcgtcgccgatcatgcgggggaggcgatcgccgatgatctgcgcgtcgagacgggccccggcatgggggccggactgttcgatgtgaccccatcgcggccagtaggggtcgccaaaacccagctgggggtgcgaatgacccgccacaacaaggatggtttggaccagctgacccggacgagtggagcccgtgaccgcagccatcttgtgtctgtcgccgtgcgcgactatctcgactccaaccctgtaaagaaaggccgacatgtccgctgatgaaactcctgccgcccggggtgggcgacgctttgatacgaccgtcaagcccaggcgccgtcccatgcttatcgccgccggtatcgccatcgtgatagtcggcgcgctcctcatcactcagttgattcgctccgcccaaaccgagcatcgcgtgctggaagtccacgccgatgtggctcgcggcgaggtcatccgtgacaccgatctggtatcggtgactgtcggccaggtcgacaacgtatcaacggttcccgcagaccagctcgactcactggtcggcaaacgcgccacggcagatcttcgagccggatcactcttgcctgctggggctatcggcccggccgatgtcgttccagctccgggcaagtcgctggtcgggctgaagctagccgccggacagatccctatcggagaccttgctgccgggacgaagctgcgcctgatccagacgtcggcacccagcggctcatccaccaccactgatagcagcaccaataccgatggccagtcgtgggaggcaacaatggcgaccggcaccaaaaagaccgagcaggtcaccttgatcaacgccgaagtgaactcgcgtgatgccgcccggatcgcccaactgacgtcacagggccgtatcgccgtagtgaaggatccgatccgatgagcaccattgttttgaccagcgtctcgggagccccaggggtcaccacgacagcgatcgggctgggcagggtctggccacaatcgagcctggtcgtcgaggatgacacccaccacgccatgctggcgggctacctgcgagcctcccagcacgccgaaccgaacctggccgcagtggcgaacctgacgtcgactccaaccaacgcccaaacggtgtgggaatctatcgccagacccctacccaccgatgacccagtcggcgggctgcgacgcaaaggcatcctcggcccgcccacgccgtggtctcgcgcaggcatcgacccccgatggggattcatgctggccctgtggcggcaactggaggaggctggcatcgacaccatcatcgatttgggtcgcctagccacaccactgacctcaacgccacacctgatcgccgcacccatcgtcgaggacgccgacatgatcttggtgatgatcgaggcgacactacgcgacatcgccggcgcccgcacgatggtggagggactcgctgagcagatgaacttggccggcgcctaccgacgtctcggactgcttgtccaccgtggcggccaggcccgcggcgtcgccgagttcaatgacaaggagatcacctcggcgttacgactcccggtcatcggggccattacccacgacccggccggagccgcccaactctccgacggggtcgggcagcggttcgacaagtcacgtctggcccactcactatcaaaggtggcggccagcctcgtcgatgccataaacaagcgccacgctgatgacgaggaggatctgtgatggccagttttgctgataatccgttcgacaagctgcgctcccaggatgcggcaagagcttcggtagagcaggagcctgatgccggattagcgtcggagttgttttcgacgtcgtcggggtgggccagctctcagcaggtgtcccaagctcaaccggtgatgacccgttcggagaacgtggattggccggttgtcgcggagctagccagtacggccactgatgaggttgaggctgagatcagcaggtggagttccactcatgatggggtggcgacgctagacattcgccaggccatcgcggagcctgctattgcctcggcggtgtctacgtatgctgaccgacgccagatcgatgtaggggagacctggcctgatctggtacgccagcgataccgcaaggctgtgtgggatcagctgttcgggatggggcggttgcagccgctgttcgaaatcagcgacgccgaaaacatcatcgtggtgggtaaccatgaggtggttgtcgaccacaacgatggttcccggtcaacgctgccgccggtggccgactcggatgccgagctggaatcccagatcgcccggatggcgaggaatgcgaccccgcggcgagccttcgacgccgatcacaccgatgtgacgatcatgcaccaacagaagttccgtatccacgcgatctcttcggaggtgtcgttgcaaccgtcggtggtcatccgccaacatttgctcacccaaatcagtctgggggacctgtcccagcggggaatgatgccggtggaagtggcccggttcctcgatgaggcggtacaagctggcaagtccatcgtggtcgccggcgagcagggggcaggcaagacgacgtttttacgagcgttgatccacgccattccgatgcgggagcggttcgccacgttggagaccgatcaggagttgttcgctcatctgatgcctggccgggaaaacacgctggtgctgttcgcccgtgatggtaacggcgaggtggatccggcgactggcacccagcacggcgctatcgagatcgcccagctgattcctcctagcctgcgccaggcgttaactagggtcattgtcggtgaggtgcgcggcaatgaggcttcggccatgttccaggctatgcagtcggggactggcactatgagcagtatccactccccgcgagcctctgaggtgccgtcccggctagcccaaatgatttcgatgggcccggtctacgatctggatcaggccatgctgcagatcggtcattcgatcgactacatcgtctttgttcgtaagcgtgacctgcctgatgggagccggctgcgatttgttgagcagatccgttcagtctcgcctggtgattcgacaactcccagtcttggcgaggtgtacacggctgactcgtggacaggccagccgcttacgccactcatgcctggttcggccgccgacgagctgtctcacttcgcccgagacctggattactgcgaggcccactcatgaacactcccgcactaaccagcgccctcatcgtgaccgggttggggctgatcctggccatcgacgggctggtcccggcgccgcctcgacctggtgccccgctgagcccggcccagaggtgggctcggctcacccaccgtcccacaggagcggccgggcgtcgccgggatttgcgttgggggttggctgttctcgtcggcgtcgtgctgtttgtgctcaccgggtgggtggctgcgctggcgttgggccccatcattgtgttgttggcccccaccctgctgggggcggccccaccgaccgatattccgctgatggaggcgttggatcggtgggtgcgtcaggtcgctgcggtgctgccacaggggcgagacatcatcacagcggtgcggatctcacggccgcgggccccgaagctgatcgccgggtcggtggatcaactggtgtcccggttggatggccgtatggagccgagggaggcgttccagcggatggccgacgagctggactcggctgaggctgacgcggtgctggcctcactagcgttggcggccactcatccgcggggagcctcgacaacgttgaaggctattgctggcaacatccaacagcggttgaaagtgctgcggcaggtggaggctgagcggtctaagccgcgtaactcggtgcgccagatcacactggtcacgatcgccatgttcggggggctgctcgtgatcggacggtcgtttctggccccgctggcgacccctcccggtcaggtgctggtggccgtggcggtggtcatgtatgtcatcgcactagtgcagatgtatcggatggcgcggccccgtcgacgcacccggatcatggtcaggaggacccgatgaccattactgctttgtccctgctggccggggccatcgtcactgtcggactgctggtcatcgtggcagcgttccgcccagccccaggccctgacctggttgccgctctggaggtggtgtcgggtcgcacctcaagcgtcgccgagaacgtcgaccagacccggatcgggcggataggtcgcagcgtgacccgcacattccatgtgtcggtgtccccggccatgcgggccgcactgcgactccaaggcacgacccccgaagcgttctacggtcgacgcctgatctgcgcactgatcggggcgatcctgccgtggctgctcaacgcggtagccatcgcggtaggggcgaattccccgaacctactcatcccttcggcgctgtgtgtggcgttagctggcgctggatggatgctgccggcagcacggttgaaggctgcggccgggcccaccaacgatgactcgttcgaagcgctgctggtattcatcgatttggtcgtgctggaacggctcgccaacgaaacctccgtcgacgcgctcaccaatgcggcaaacatgtcggactcgccgctattcgtccagatccgtcaagtcctcaaccgtgcctccctggaaaacgtcgacccgtggaacgggctagaccggctagccgaggacatcaaactgcccgaactcaccgatgtggtctccatcgcccgcctccaaaacgaaggcgcctccctcgtcgacagtttccgggcccgagtcgccgagttgcgcgacgcctacctgctgcgcctgcaacaagaatccaccgccatcacccagcggcttggtttgtggacgatcctgcaagccggctcggtcatgctcatcttgctgggggcggccgccctcacactcatcacagccggataaaccgacatcgtgtcgagcccccatatgggccgcgaacctttcataatgatgcctgtaagcaccacaatattgatcacaacctaacaatgaaggagaaatcatgatgaccgatctcgacctggctaaaaaacagatcacctggctggcggcgcacctgcgttcccggatcgttgacgagcgtggcggtggtagctctaccgtggagacactgatttggattggtgtcatcgtggcgctggtgattggtgtgggcgtcggggtgacggcctatatcaggtcgaagatgcctcactgacgacgatgcgtagcaggttcacaactgatcagcgtggcggtggtagcgcgtcggtggggatgctcctgctgatgcctgcgatcatgctgctggcattcggtgggatcgaggtcgggatgtggtgtcacgcccatcagtcgaccatcgcggcagcccaaagcgccgcggaggctcagcgtgtcgtccatccggtcccggggtcggcacaggaggcagcctcgcagatcactagtcatggcggggtgcgtgatacccggatatcggtcagtgatgacggggccactgtcacggtgaccgtctcaggtcgggccccatcgatgctggggctgcatcttccggctgtgtcgtcgacagcgtcgatgcccaaggagcgcctgtcgtgaggcgaagtgagcgcggtggagcaagtctaagcgtcgaggtgctcatgtgggcgccgatcgcgctggtgatcatcgggtttgttgtgggtatcggccggatgtcgatggcccaggacgcggtgaatggcgcggcgggtgctgcggcccgtgcggcgtcgttggagcgtgatggacagtcggctcagtctgcggcgcagcaggcggcgtcggcgaacctgtcgtccggtgggctggcatgtgcgccgagtgtgagcgtggacacgtcagtgtttgcccgtcctgccgggcaggcgggcacggttcacgccacggtcacgtgtgtcacctcgctgggtcttgggttcgggtcccggacggtgcacgcaacggggtctgccccggtagacacctatcgggaaaggagaggctgagatggcccgtgatgagcgtggtggcggctcggtgtcggtgtggatgctgctcatggtgccggtgattctggtcatggccggcctggtttttgacgggtcccgtcagatatcggcaacccaggcggcccaggacgcggcggttgcggcatcccgcgccggaactgatgcggcagcgacaccgcagcttgctggccacgacggggcggccgtagcagtccaagcggcccgccaggcactatctgctgccggggtggacgggtcggtgcaggaggacgggtcgaccatcacggtgaccacgtctcaaagtcggccgacagtgttcctgtcagcgatcggaatcagccaggtaagggggcatgggcaggcccatgctcagcttgtgggaccgggagaacgcccatgacagtgatacgtcgtatcggtgccctggtggcactgctggtggtgatagccggcttaccggccgggctcgtggccgcaggcgccccgctagtaccctcgggcctgtcatgggcccatgtgcggcatctgttggttaccccagacatgaccgggtcggtgctggtgtggctggtcagcctcatcggctggatcgggtgggcatggttcgccctggccgtcgcagccgaagcggtgacgatgctctcagggcagcggctgcactggcacatgcccggccctcgcctagtgcgccgagtggcagccggtcttctcattgccgcgttcgcggccgcaccggcagccacaagcacggctcacgccgccgaggccacccatgtggcggtcgccgcccaggctggaccggcacacgcggcccccgcccaggacagccccgccaccacctctcaggccccggacgcctccaccactccgaaaatctggaagacctacacggtgcgggccaacgactacctgtggaagatcgccgagcactactacggtga

SEQ ID NO: 218 - DNA, 2098 bp, Propionibacterium acnes
ttggtattggtaggcgatggtgtcaccggttttgttgcggatgacgtcgaagccttcgatgtcggaggggatgtcgtcggcgtcgtagacgacggtggtggtgacggggttggaggccgacatttggccgatggtcacgcgcagcatgtttttcaacgcggaggtgaggattgtcgtggcggtggggtttttgtctgcccagcgtttctcggcgatgtcgatcatgtcttggatggttttgacccatcctcggatgggatcgactttggtcagtttgatcccttcgaggaactcgatgggctgggtgatgggcccatccggtccggcttcggtgtcccagccttcgtcgatggctagtttcagttcggcggtatcgacccatgtttcgtgggtggtgccgggcacgttgggccaaaaccatcctgctcgtcctttggtgcgtttgaccggtagtaggccgatgtcgtcccaccaggatggcacggtgaagcggatgtggtagcgggccgggtgccaggggttgttggtgaacaggtcgcgggcttcggtggcgctgagcagagtggcgggtgcggcaccgatctctccggtcactgatccggcatacatgaatcggccgtcgatgtacacgaagttagggatagggccggcaggcacggtggggcgccagcccttttcgcggtcctcggggttgccgtcgtcgacgcatagttcgtagcggtgctgaggggaggtgtgttggatgagtgcgcccagttcggggtccatcggctccatgcgataggactcgggggtccgtagcttccagaggttgattccttctgctccggggcggtccatgagggcccagtcgcggtcgattctggtggcgatgatgtgggtcagttctcgccatgcccagcgggcctggattggggtgagggtctggccagggaaccattcatcagcgaccagaatgtcgaggttgcggtcggtttctttgtgggtgaaccggcctcgggcgggccgcccggacagcatgaacaggccccgcacgtgccagtcctggttgaactcgcgggtgtgagcgggggtgtcaggcagcagccaggattgaggctggtcggggatgttaccgcagacgatcaggcgtcgggcgttgtggtgtagcgcggttgttagcaggtctgacagggtcgcgtgcttggtgcgtcgtccccccagcactggcaggatctcgtttccggccgcgtcgactccccgggcggtgtcgatgtctagccacactgtttcggggtcggggggccgatgtggggcgggacggcgctgctcctggtcgtctctcatggtttcctcctttgggccagggagcggccggcgtcgagggcgttcatgcgctcgcgttgttcttcgcgtagttggtagacccggcctcgtgacactcctgctgcctcggcgatggtggtggccggcaggtggccgatggcggcagcgtcggcaaggacgtcacgccaggccaggtcaatggttcccagctgggctagagcttcgtcgcggcggcgggtggcatcagccactacggaggcccaccctgtggggtggatggtcttgacgacgattcggttgtggcggatggggccccatgcatcagcggggacttgccagccgtgattggcggcggactcggtgatcttgaggcgtcgctcaggtgcgcgggtgcgggcagtgacgtcggtgttccaggtctggactggtacccacgtcccctctcggatgcgttcgatgacgcacgtggtgacctcgtcggtgactgtgatgaccagacgataatctttcccgtctggggtggttcggtagctgggcatgtcaccctcccctatctgtcaaatgagctagacacagtgtctatttaatttgacgcaaagtcaagtgtgctagacgcctttgtgtggatccgcccgcccagacaggcactcacgtctcatgacccgccgcgacgtcttaacgaaaccaaaccgcttatagaaccgctccgcagcgggcccggagggcttcagttcgagggtgagaccttgctggtcggcccattggcagacttgtgtgaggatctgtgagccgt

SEQ ID NO: 219 - DNA, 1726 bp, Propionibacterium acnes
cctcgctgactacctgcccgcctgatcccaccccaatccactcgggcgcctgtcagtgccccctcttctgggtggtggtccggggcgtcaccgccccggaccagttgggtagtcatctcagttgaaataagcgattagtgatacgcccctcctgctttccggtgctgtcatgagcgtctgacaacagcgacacctcggggcagccgacggacagtcctctggctgccgctctgatcccatgcccacggcacgaaggtgtcggacagctcggtctcgtcatgtgcccaaatagcgtcgtgggcctgtcgccaagcttctcgggagccccacacgggcacgaccgggccacaccggtgtcctggtctccagtgtcgcgacactgtcgatttcggtacgtgcaatgcggcggcggtttgacggatcgacatcccagactcccgcgcgtcccagatcgccatgtggagagtatttgcctccagtgcggccgccacacttgcacgctctcgcgcacgctcgaatgcccgcctagtgctctcaaatgtcgtcacgacgcctccccctgaaaatactcagggtgtcccacggtgggacaccctgagtatttcataccccaactcgcctcaccacacgtcgacctcgacaccgactagccgacccctatcggcgacattgccatactgctgacccgcctggtcctctagccacgacaacgcatcccgaaacagcccgacgtcttccaaagctaaaccgcagtcgtagccgcccttgtcccccaaccgcacaatctggcgctcccgacggccaccttcatcgacttcgatccatagtttcgcgtgcatccgctggccgcggccttctgacaggatctcggtgagcagatcggaggctcgcatcctcgttaccgcgagggaattggagtgtgtgggaggaacgacgatgggggaggttggtgacctcgtgacgcagcaggttgcgcttgtgcatctgccgttcgaggcgctcgggctgactcgttgacggggttgtgccgtggcgccgcttcctcggcggggtctcgatccgttgctcttccggcggttcggcgtcaggttgtggtgcgcgatctcccctaggacgggggggctcaccacctatatccgagggacgatgagacggccttccacgcttgctgcgcactttcgcagcccgccccttgcggtcacatcgacgcggcggcggggtaacctcctcgccccgctccaactgtgttaacgccgccaccaggttggtgcccggtttcagcccttttagcacgaaccgcaccaggcgggggtctcggccgattcgtcgggcaatctcggcttggctccacccctcggccaacagggtgcgcaccaagtcttgggcccggttatcacgctcagtcactggtcgccccctcggggagtcctgcctgctcggcctgctctgatagagcagcccgctccgatccggtctgaggcgctttcaggggcccgggcaagacacctttgacacgcagccgcccgtccttgccgtcatcgccgcccccctgggccacagggagcgcccaggggggcacgttgctggtgtagatggcgtcgccgtggatggccagcagggtgcgggagttcatgcgtagtgctcctcccttggttgtggcgttttttccggtggtggggtcggcgatgggtgtgttgagggtgcgtacgcgggacagggcccagat

SEQ ID NO: 220 - DNA, 619 bp, Propionibacterium acnes
ggcggtggctcgaccaggtcgccgacaaccccggcttcctcgacacccttatcgaggccgcccgcatcaccgatggatggcatcacgcgacgcctccgcacattcaggccccttaccggacccttcatcagtgaacggaggtacaacgacatgaccagcgacattgacattgaccggacccacaaacccgacgaccgcgccgaggctcctctttaccggtcctgggccaggagactcgtgcacgtctccgggatgccctggcgtatcgtcgccgccttggccggggtctcccccacctccatgcaccggcttctattcggccgcaacggtcgacccgtggaatggatcggcatcaatgatgctcgcgccctgatggatatcggcatcgatgatctcgcctcagcgtccaccgaccgtatcccggcccgcgaatcccgcgagctgttggtagccctgcacaccctcggctggaccaacgcgcacttgagccgctggctgaccagttccgacctcgacctggccaccacccccaaggccctctacgtcactcgactatccgccgcccgcatccaggccacctacgacatgctcatcagccagcccgtccgccgctgcggcc

SEQ ID NO: 221 - DNA, 8774 bp, Propionibacterium acnes
gaaggttccctagacccggccgatgtgcggagggatttcagtgttttatcgaggtgaccagccagccggtctgcgctgcgggttcaggtaccagggtcagatgcaccacggtgtggtcggctaggggcacggcgaccaggggcccgtcggcgctcgccccggtgagggtgggagttccggccacggtggtggcgggaatctggttgggtttcgcggccatcagggagcccatgagggtcggggcggcgatctggacgagggcgactttgcgggcggcgggatcgcgggtcaaccagccgcgggtgaaggtgagcgcagccgacgtgatatcggggctcagcggggctggtgtggcggcggggtgggccgttgaggagggccatacgcgcggtagcgctggcgacatcgagcgggtcggagtggggtcaggtgtggggcttagggtccgatgtggcgatggggctaccgccccggtggtgggagacgagactggttgggggtggtgttgagggcgtgggatcagggtgaaggcagccaaactggccgggatgaggatgacggccgcgccgacacttcggagcgaggtcatgtgacgatccttcggtagctcgacgggttgccgtagatcttttccacgttgatgccactatgtgggttgtcggcgctaaccatttggcctccaccgatgtagacggccacgtggtgggcagggcttccccagaggatgaggtcgccgactttgagctggtcacgggccacagcagtgccgactttctgctggtcggcggcggtgcggggaaggctaatgccgatacgccggtacagcgccgaggtcaggcctgagcagtcgtagccgccatcggctttgccgttaccaccccacacgtaggcgtaggagttgttgtcggcgatcgatttggcccatgccacggcttcggccaggttcttcgacacaccggtctcgttagcggccccggtggcacagttgtttgacaggtgccctgtagtagtggatcccactatttgtttggccatggtttcccatttggcgtaggcatcgggcagggctgagccttgcactgcctgagctgcctgcgtcagcggcatcttctgccagtcagcgatgtcgactaaaccgggaatgtggaatccagggccgccggccgatccggggccagcgtaggtgatggtgtggcctttcaagaacgcctcggtggcgtaggcatcattgttgacctgatccagagtcccgtaccagcccggcaggatgcgctgctgaaaggggccggcgtcaccgtcaccgttagccttcgctgaggtagggtcggccccaagatctgattcttgtttggcggtcatgatagcgatgaccgctgcctgggtaggcagtttgtcacgctggaccacagtgacgatggtggtcacgagctgcttctgcctggccgtgaggcctccggcacccacagtgcctccggtgacggtacccacgcaagcatccccgccgacactgccaccgccgccgccagagttgtcgtcgagggccccagagcctactgacagcagcggcacaatgatcacggtcgctggcaagaccgccaggcccgccagcatcagcactgctgcactcaccacggcgatcacgtgagatgctttcaacgctgcccacctctcgctggtttgagggggcgacgcctgctggtacgcacaggcttggttgatccagtccgccgttgattggcaggcctgggtttgatcggcttgctgggacccggtttgggctccggagtcttaggctccggcttcacatgcctaggcacttcggctgcggtgggaggagtcagcacgtggcgtaccggcttggtgaccttctgggcacccgaaacaaccggcttagacaccaccttggcacctttgaccaccggtgcggctgccttcgcgccggccttcttgactgcacgatgcgctttgatagccccggcctcggcccggccaaccctactagcagtagcatcgagggctctgtggcccgtcgttgccctcaccggtgcatccttgccctggcgggtctgcttcgcgatcgccgacatgccgcctcgcaatgccgaaacatgattgtgggcgtgggcgatcgccgacatgccggccgtcgcgatttttgactggccctgcggggcccctgccccagcacgaatctgccggtaagccgccgacgtgccacgagcacccgccgccattcgcgccaccttcgcagccctagtcactcccgtcgacacgccacccgtggctaccgcagcagcacccgagaccacagtcgaggccatccgccttcgacccgatccggtgagcttgcgaccaccactgcgcaccatccggcgagcaccccgcccagcccactggccgatcaccgagcccctttcggaacgcttgctgcgcatccaatcgttgatcttgtccctcagccccttctcgcccttgtgacgacgccacatggacatcaagaacccgataatccccacgagctcgagcatgttgacaaccatgaccttgatggcgacatcaccgtcagaggcgaaaaccgacttgatgatgagcatgaccacacccaacatcaccatcgacccgacaatgccgatcatcgagtacaagatcgaacacagatcccggatgagcggatctgtgcggccagggatagcccgcaacacgttgagcatcgacataaacgccgaccacaccaacttgcacacgtagaaccagcacatgcccgcgaacaccagcaggaccacagccaaacccgccaccgtcgacgagtaaaagaagaaacccaccaaccacgaaccatccgcaatatcgccggcgtaatccgacaacccctcatcacagtcaccaaggtcgtcgcgagcatccgagacgtcatcgtaagggccacccttgagcacctcgatgtacttgtcgtggcacttcgcatcaataatccggccatagttgagctgctgatgaaccggcgccacgaacgagtccacaatgatcgccgacagcttcggatccttcgagtctcccgtcgaggtcatgtcatcaggaatctcgacctcaccagcggtcgccgtcgcaggatcaaccgaactagtaatcatccgagacagcgccacaccgaactgctgggtgcgagccaacggagtagccaacgtcgtcgtatcgcctgcgaacttcgccaccggggccgccaagaaacccaacgccagcgccgcagcaatcgccgcacgcgcacccgtagcccacgccccagccgtacgtcccctcatcatcttgacgaccacgcccacaccggcgcacgtcgtcagcaacgtcaacaccgttccaccccagctgtccgctcccagcggggccaaaaccttgtcgtggatatcgttctgcaaccccaccagcgggccggtaatccacccgacccagctcatcgccacggtccagtccaacaaccggcacagcaacgcaatgaccatcaggtacgtgttccaacacataccaataatggaggcccacatagccttcaacggggccgtaacgccaccatcgtccatcgacatctggtactgaaacaagtgaataccgttggagtcagtcacattgaaaccgtcacccatccagcccagccccgggcccgacgccatagcaggcacactgctcagcgccaccaccaaaaccagcgtggtgacgatgatacggaaccaccgctccccggccccggggcggcgtggatgacggctcacgctgtctcccggtcgtgctcgggcgggttggagctggcggcttcgcggtggggagcgtaggcaggtctcagtagtcgaatttcaccgacgttgccgtgctgatcggcgtacaggccacaaccggggcctccggggttgagggcaatcttgaccaggtcagcgaactcttcaggggacgttttagggtccacgcccaggaactcgacacctttctgggcgaggttgatgttgtcgcacagcaacacgatgcgatgctgaatgaggttgcggacggtctcgttggggtaatcggcctcggggtcgtgggagccagtaatgagccaggcgttggctcggcgggattcgcgcacgtactcatcgatggcgtgggaggcttccggcgaggacgacatatggtggaactcgtcaacgatgaaagcggcgtcgcgggcccggtcgctgaagcacaccaggcgagccagacgggcaataagcgcgtagagggctcggccaaacaccttgtgcgggggcagctgccgaaacaaatgttctgacagcatctcctcggcgttaggaagagcgatgccacaagtgccaatgatgaggatgtcggcactcaggtcggcgggaggaaggtccgggtcaaagatggccgaagctagggaggccgagttctcgatgtcagcgaacacggcaatcctgtcagcgatcgcggtggcctcgggaaggtcgcactcctcggccaggtggcgggccaaacgcccacacgaggtgatctggtggtcacgcatgtaggccggtttgaggaccttggccagcgtggtcccggccacaccgatggtctccaagttaagcaaggtcagcaagaacgactgggcgacctgcccggccatctccgggggaaggatgcgcagcgggtccagcgacagcttggggtgggccgtgtcgacgatctggcgtctaaccccgtcgatagagttgacaaaggttacccactcccgctcatcggagttgtcggtggcaataatgcgcccgccccgggccgcgatggctgcgcacagccgcttctcggccatcgtcttgcccgcgcccatcttgccgatgaacgccaccgtgttgcctttctgatcctgagtgtcggcatgcaaatcgaggtaggccagcgactgcaacggggagcctgtgaccacagccaacgggatgccggtggtacggcccaaccggtactcaaccaccgggatagatgcggcgaacgcggaggcgtgagtcagctgacggtaggcgttaagcgaggaggagaaccggccaccgggccgggcagcccacagcaagtcctcctgacggcccacgggacgcacccacgtgaagtcaccgaacaccggatcattgacgaacgctcctgccagctcctcggtggtctcaaagtcaggagacgagacagtgacggtgataagagcctggatctcgacctcacgctcatcggcggccagctcggcgttgtagtcgacgagcacctgagcggaatgctcgatagacatgagggtcgaagcctgggtcatctcaccgccctcaacattgtcgagctgatcgacggtttggcggatggcccgctgatttttctgcatcgcagcgtgacgggtccgggccactccccggatcgccacgtcgaccggcacgccagtgtcgtcgatacggcccaagaactcgtaggcaggccacgtcatcgtgcggggcaccttacccagcacgatatgggactggtagacggtctcgccggtgtcggcaccgattttgaggacgcgacgattccacgcctgagccgtccgggacatgtgggagactcgcttgtcatcctcgctggccagcaggtcggaggtcgcggcctcatcgatgaccaactcccccagcgcggcacgtccaacctcatccatgagggcgattccctcgccaggggcatcatcacgcaaccgggtcgggtggcctgacaggtgctgccgaagccagatctgttcatcaacggtgaccgggcggggttggaacgctgccggcagtttcgcaccgaattccttagcctgacggagggcccactcccgtgcgacacggccaggagcggtggtcatgagtccggcgacttcggtgattttgttgagggcggcggtccaggcggtgtgggtgcgtattttctggtcttggttgagtttgatcgataggaaccacacgcgccggcctagggatgcggtttcaggctggtcgagggtggcgtcgatttcgtcggcccacacggggtgttcgctcaggtcgaggccggcggccatggcgtcgacgatttctgtggggtcggtccaggtgagggccccgttgaggcagaactcgtggcgggcgaggtggcggaataggtcgcggtgagctgcggcgacggtgagggaggcgttctcggtgacgggtcgctggaggggagtaagtcgccaagtggcccagatgtcgccggtggaggtccagacgaggttgtcgaagaggaaccgttcggggatggacatcatgactccttttcggcggcggcgaggaaggcttccaggccgctgcggcgtacagcgttcccagtagggtgcaggggttttctgggggtgggttcagatttcgaatgtgggaagagtttgtggatggtatcggtgtcctcggcgagggcttggtcgagcaggcaggtggccggggtgtcggtcatctcgtccagctcgtcgatcatctcgtcgaggaggttgggggtggtggatgcggcccacacaggtgggatagccggtgcgggtcgaggcggtgtggggaggcggagtttggtttggccccagaggggtgtgtgggtcatgccggcgggagtggtggcggcgtgagtggtcacacgccaccagcccgacagccatgccagaggtgaccaggtccagtcgatgcgaccaacaacgaactgggcgagccatccggcagccagcgcgaaaatgaaaccgcggatggtcatgcccccgtcgataattttgaagcccatcatcgcggcaggaactacaccgccgacagcgagcacctgatagatcgtgtagggcccgccaggaatccttcgacctgaggaatccttgccgataatgcggggctgctggcgggcctcggtgtgccactgaatatccacgatcagctcttgcccaatccttgcatcatctgtccgaagaattggatcgcgttaccttcgataagccagtgcgccataccacacacaaacagcatggagacgatcttggccaggctcataccgtgtttgaagatgttgaacgcggcaatgcccacgactacgaccatggcgacggctcgcaccgcggactgaccttcacctgccttgatcgtcgtccattcgaagaggttctgcgattccagtggcagcaggaggaattgatcgagcatgagaggttttcctttcaggaagccgaccgggatggtcccggtactgacgggctggacggcacgggtgtgccggccaggggcagaaggcgtgacggctggtcgagggcggcaacctcccagcgtcctgcacgactgacaagagtcaggccgtactggctagtccgggtagtggattcgtcaccggtgggctggcatgtcacggtcaccgtgacggtaatcttctgccgatctgagggggtggggacctcgtcaggccccaccacatgagtggttttcaccgatacacacggggctgggtcaaccgcggtgaaagcggtccccgggctactccatctcgacaggtcagtattcccggtcagcatggcggccaagaaacccgaagaggtctgggcagccgggtcagcaggacgaatctccgaggagtccacgtcgggggctgaggccggtgcaggcatggggatctgcccaggtagacgcaaggcgatggccttgccgccggcatcgacgtggaccggaaccgaccaggcctgtccgctcccggattggccgcccatggtgaccacggtgacctgccacaggctcggatcagacggggagacggtagcgtcataggcggtgacggtggtgggcgctggaccaggtttgcggggcatgcgcgcatcggtgatcttggccgccaccaggtgttccagattgtccaagtgcccggagtcagaggtcagcagaagagtagtcacctcgaccgcggtggctgaggcgatctgagctgtgcggcggtcgtgatgggtggtgtcagtgctgacagctgtggtgggagcggatgccggggccgccgaacggaccagggcaacggggccgcatgcgactccgcacagcacgagggcaaggaagcctttggtggccatcgatccggtgtggggccagggacccacgttttcctgtgcctgttttttcttggccgaccaacggcgggacttagggttagcggatgcaccttctggggtgcatgctcgtctcaatcgcatcggtcacctccttcactggatgaagggaccaaggaggtgaccgatgtgcggtcgaacccgaaaaagttcaaacttttttctgggtctgcctcaagtacgacagaaggcctgcatcatcacggcgttgtggtagcagatcttgcgtcagcgcaaatgcatgggcctcgtaggagtagctcttaggtaggtcccggtggttgcggccagggcgagggtgtcgggtatgtgtagcgctagtcccgggttcgtggtgtgagggcttttgggtgctgacatgcactacccattgctagacgctgtgctgtggcatggctggacgtctagcagacgggttgacatcacctttaggctggcagcgcccgaggccgcaggccagaggaagcggacagcctaacgattgacgtccccctctcctttccccaacctcctggagtcgatgacccggagatagatcgatgtctatgcatcggtgcatcgatatacctatgtatctgtctgtggtttttagaggccactcccgtcgccccgggccgctcagcgataccgcaaggctgtgtgggatcag

SEQ ID NO: 222 - DNA, 8231 bp, Propionibacterium acnes
gggatgaggatgacggccgcgccgacacttcggagcgaggtcatgtgacgatccttcggtagctcgacgggttgccgtagatcttttccacgttgatgccgctgtgggggttgtcggcgctaaccatttggcctccaccgatgtagacggccacgtggtgggcagggcttccccagaggatgaggtcgccgactttgagctggtcacgggccaccgcggtgccgacgtgctgttgttcggcggcggtgcggggaaggctaatgccgatacgccggtacagcgccgaggtcaggcctgagcagtcgtagccgccatcggctttgccgttgccaccccacacgtaggcgtaggagttgttgtcggcgatcgatttggcccatgccacggcttcggccaggttcttcgacacaccggtctcgttagcggccccggtggcacagttgtttgacaggtgccctgtagtagtggatcccactatttgtttggccatggtttcccatttggcgtaggcatcgggcagggctgagccttgcactgcctgagctgcctgcgtcagcggcatcttctgccagtcagcgatgtcgactaaaccgggaatgtggaatccagggccgccggccgatccggggccagcgtaggtgatggtgtggcctttcaagaacgcctcggtggcgtaggcatcattgttgacctgatccagagtcccgtaccagcccggcaggatgcgctgctgaaaggggccggcgtcaccgtcaccgttagccttcgctgaggtagggtcggccccaagatctgattcttgtttggcggtcatgatagcgatgaccgctgcctgggtaggcagtttgtcacgctggaccacagtgacgatggtggtcacgagctgcttctgcctggccgtgaggcctccggcacccacagtgcctccggtgacggtacccacgcaagcatccccgccgacactgccaccgccgccgccagagttgtcgtcgagggccccagagcctactgacagcagcggcacaatgatcacggtcgcgggcaagaccgccaggcccgccagcatcagcactgctgcactcaccacggcgatcacgtgagatgctttcaacgctgcccacctctcgctggtttgagggggcgacgcctgctggtacgcacaggcttggttgatccagtccgccgttgattggcaggcctgggtttgatcggcttgctgggacccggtttgggctccggagtcttaggctccggcttcacatgcctaggcacttcggctgcggtgggaggagtcagcacgtggcgtaccggcttggtgaccttctgggcacccgaaacaaccggcttagacaccaccttggcacctttgaccaccggtgcggctgccttcgcgccggccttcttgactgcacgatgcgctttgatagccccggcctcggcccggccaaccctactagcagtagcatcgagggctctgtggcccgtcgttgccctcaccggtgcatccttgccctggcgggtctgcttagcgatcgccgacatgccgcctcgcaatgccgaaacatgattgtgggcgtgggcgatcgccgacataccggccgtcgcgatttttgactggccctgcggggcccctgccccagcacgaatctgccggtaagccgccgacgtgccacgagcacccgccgccattcgcgccaccttcgcagccctagtcactcccgtcgacacgccacccgtggctaccgcagcagcacccgagaccacagtcgaggccatccgccttcgacccaatccggtgagcttgcgaccaccgctgcgcaccatccggcgagcaccccgcccagcccactggccgatcaccgagcccctttcggaacgcttgctgcgcatccaatcgttgatcttgtccctcagccccttctcgcccttgtgacgacgccacatggacatcaagaacccgataatccccacgagctcgagcatgttgacaaccatgaccttgatggcgacatcaccgtcagaggcgaaaaccgacttgatgatgagcatgaccacacccaacatcaccatcgacccgacaatgccgatcatcgagtacaagatcgaacacagatcccggatgagcggatctgtgcggccagggatagcccgcaacacgttgagcatcgacatgaacgccgaccacaccaacttgcacacgtagaaccagcacatgcccgcgaacaccagcaggaccacagccaaacccgccaccgtcgacgagtaaaagaagaaccccaccaaccacgaaccatccgcaatatcgccggcgtaatccgacaacccctcatcacagtcaccaaggtcgtcgcgagcatccgagacgtcatcgtaagggccacccttgagcacctcgatgtacttgtcgtggcacttcgcatcaataatccggccatagttgagctgctgatgaaccggcgccacgaacgagtccacaatgatcgccgacagcttcggatccttcgagtctcccgtcgaggtcatgtcatcaggaatctcgacctcaccagcggtcgccgtcgcaggatcaaccgaactggtaatcatccgagacagcgccacaccgaactgctgggtgcgagccagcggagtagccaacgtcgtcgtatcgcctgcgaacttcgccaccggggccgccaagaaacccaacgccagcgccgcagcaatcgccgcacgcgcccccgtagcccacgcccctgccgtacgtcccctcatcatcttgacgaccacgcccacaccggcgcacgtcgtcagcaacgtcaacaccgttccaccccagctgtccgctcccagcggggccaaaaccttgtcgtggatgtcgttctgtaaccccaccagcggtccggtaatccacccgacccagctcatcgccacggtccagtccaacaaccggcacaacagggcaatgaccatcaggtacgtgttccaacacatgccaataatggaggcccacatagccttcagcggggccgtaacgccaccatcgtccatcgacatctggtactgaaacaagtgaataccgttggagtcagtcacattgaaaccgtcacccatccagcccagccccgggcccgatgccatggcaggcacactgctcagcgccaccaccaaaaccagcgtggtgacgatgatacggaaccgccgctccccggccccggggcggcgtggatgacggctcacgctgtctcctggtcgtgctcgggcgggttggagctggcggcttcgcggtggggagcgtaggcaggtctcagtagtcgaatttcaccgacgttgccgtgttggtcggcgtacaggccacaaccggggcctccggggttgagggcaatcttgaccaggtcagcgaactcttcaggggacgtcttagggtccacgcccaggaactcgacacctttctgggcgaggttgatgttgtcgcacagcaacacgatgcgatgctgaatgaggttgcggacggtctcgttggggtaatcggcctcggggtcgtgggagccggtgataagccaggcattggctcggcgggattcgcgcacgtactcgtcaatggcgtgggaggcttccggcgaggacgacatgtgatgaaactcgtcaacaatgaaagcggcgtcgcgggcccggtcgctgaagcacaccaggcgagccagacgggcaataagcgcgtagagggctcgaccaaacaccttgtgcgggggcagctgccgaaacaaatgttctgacagcatctcctcggcgttaggaagagcgatgccacaagtgccaatgatgaggatgtcggcactcaggtcggcgggaggaaggtccgggtcaaagatggccgaagctagggaggccgagttctcgatgtcagcgaacacggcaatcctgtcagcgatcgcggtggcctcgggaaggtcgcactcctcggccaggtggcgggccaaacgcccacacgaggtgatctggtggtcacgcatgtaggccggtttgaggaccttggccagcgtggtcccggccacaccgatggtctccaagttaagcaaggtcagcaagaacgactgggcgacctgcccggccatctccgggggaaggatgcgcagcgggtccagcgacagcttggggtgggccgtgtcgacgatctggcgtctaaccccgtcgatagagttgacaaaggttacccactcccgctcatcggagttgtcggtggcaataatgcgcccgccccgggccgcgatggctgcgcacagccgcttctcggccatcgtcttgcccgcgcccatcttgccgatgaacgccaccgtgttgcctttctgatcctgagtgtcggcatgcaaatcgaggtaggccagcgactgcaacggggagcctgtgaccacagccaacgggatgccggtggtacggcccaaccggtactcaaccaccgggatagatgcggcgaacgcggaggcgtgagtcagctgacggtaggcgttaagcgaggaggagaaccggccaccgggccgggcagcccacagcaagtcctcctgacggcccacgggacgcacccacgtgaagtcaccgaacaccggatcattgacgaacgctcctgccagctcctcggtggtctcaaagtcaggagacgagacagtgacggtgataagagcctggatctcgacctcacgctcatcggcggccagctcggcgttgtagtcgacgagcacctgagcggaatgctcgatagacatgagggtcgaagcctgggtcatctcaccgccctcaacattgtcgagctgatcgaccgtttgacggatagcccgctgatttttctgcatcgcagcgtgacgggtccgggccactccccggatcgccacgtcgaccggcacgccagtgtcgtcgatacggcccaaaaactcgtaggcaggccacgtcatcgtgcggggcaccttacccagcacgatatgggactggtagacggtctcgccggtgtcggcaccgattttgaggacgcgacgattccacgcctgagccgtccgggacatgtgggagactcgcttgtcatcctcgctggccagcaggtcggaggtcgcggcctcatcgatgaccaactcccccagcgcggcacgtccaacctcatccatgagggcgattccctcgccaggggcatcatcacgcaaccgggtcgggtggcctgacaggtgctgccgaagccagatctgttcatcaacggtgaccgggcggggttggaacgctgccggcagtttcgcaccgaattccttagcctgacggagggcccactcccgtgcgacacggccaggagcggtggtcatgagtccggcggcttcggtgattttgttgagggcggcggtccaggcggtgtgggtgcgtattttctggtcttggttgagtttgatcgataggaaccacacgcgccggcctagggattcggtttcaggctggtcgagggtggcgtcgatttcgtcggcccacacggggtgttcgctcaggtcaaggccggcggccatggcgtcgacgatttctgtggggtcggtccaggtgagggctccgttgaggcagaactcgtggcgggcgaggtggcggaataggtcgcggtgagctgcggcgacggtgagggaggcgttctcggtgacgggtcgctggaggggagtgagtcgccaggtggcccagatgtcgccggtggaggtccagacgaggttgtcgaagaggaaccgttcggggatggacatcatgactccttttcggcggcggcgaggaaggcttccaggccgctgcggcgtacagcgttcccggtagggtgcaggggttttctgggggtgggttcagatttcgaatgtgggaagagtttgtggatggtatcggtgtcctcggcgagggcttggtcgagcaggcaggtggccggggtgtcggtagtctcgtccagctcgtcgatcatctcgtcgaggaggttgggggtggtggatgcggcccacacaggtgggatagccggtgcgggtcgaggcggtgtggggaggcggagtttggtttggccccagaggggtgtgtgggtcatgccggcgggagtggtggcggcgtgagtggtcacacgccaccagcccgacagccatgccagaggtgaccaggtccagtcgatgcgaccaacaacgaactgggcgagccatccggcagccagcgcgaaaatgaaaccgcggatggtcatgcccccgtcgataattttgaagcccatcatcgcggcaggaactacgccgccgacagcgagcacctgatagatcgtgtagggcccgccaggaatccttcgacctgaggaatccttaccgataatgcggggctgctggcgggcctcggtgtgccactgaatatccacgatcagctcttgcccaatccttgcatcatctgtccgaagaattggatcgcgttaccttcgataagccagtgcgccataccacacacaaacagcatggagacgatcttggccaggctcataccgtgtttgaagatgttgaacgcggcaatgcccacgactacgaccatggcgacggctcgcaccgcggactgaccttcacctgccttgatcgtcgtccattcgaagaggttctgcgattccagtggcagcaggaggaattgatcgagcatgagaggttttcctttcaggaagccgaccgggatggtcccggtactgacgggctggacggcacgggtgtgccggccaggggcagaaggcgtgacggctggtcgagggaggcaacctcccagcggcctgcacggctgacaagagtcaggccgtactggctggtccgggtagtggattcgtcgccggtgggctggcatgtcacggtcaccgtgacggtaatcttctgccggtctgagggggtggggacctcgtcaggtcccaccacatgagtggttttcactgatacgcatggggctgggtcaaccgcggtgaaagcggtccctgggctgctccatctcgacaggtcggtattcccggtcagcatggcggttaggaagcctgaagaggcttgggcggccgggtcggcggtgcgaagctccgaggtgtctagggtgggggctgaggccggtgcaggcatggggatctgtccaggtagacgcaaggcgatggccttgccgttggaatcgacgtggaccgggactgaccaggcctgtccgctcccggattggccgcccatggtgaccacggtgacctgccacaggctcggatcagacggggagacggtagcgtcataggcggtgacggtggtgggcgctggaccaggtttgcggggcatgcgcgcatcggtgatcttggccgccaccaggtgttccagattgtccaagtgcccggagtcagaggtcagcagaagagtagtcacctcgaccgcggtggctgaggcgatctgagctgtgcggcggtcgtgatgggtggtgtcagtgctgacagctgtggtgggagcggatgccggggccgccgaacggaccagggcaacggggccgcatgcgactccgcacagcacgagggcaaggaagcctttggtggccatcgatccggtgtggggccagggacccacgttttcctgtgcctgttttttcttggccgaccaacggcgggacttagggttagcggatgcaccttctggggtgcatgctcgtctcaatcgcatcggtcacctccttcactggatgaagggaccaaggaggtgaccgatgtgcggtcgaacccgaaaaagttcaaacttttttctgggtctgcctcaagtacgacagaaggcctgcatcatcacggcgttgtggtagcagatcttgcgtcagcgcaaatgtatgggcctcgtaggagtagctcttaggtgggtcccggtggttgcggccagggcgagggtgtcgggtatgtgtagcgctagtcccgggttcgtggtgtgagggcttttgggtgctgacatgcactacccattgctagacgctgtgctgtggcatggctggacgtctagcagacgggttgacatcacctttaggctggcagcgcccgaggccgcaggccagaggaagcggacagcctaacgattgacgtccccctctcctttccccaacctcctggagtcgatgacccggagatagatcgatgtctatgcatctgtgcatcgatatacctatgtatctgtctgtggtttttagaggccactcccgtcgccccgggccgctcagcgataccgcaaggctgtgtgggatcagct

SEQ ID NO: 223 - DNA, 2020 bp, Propionibacterium acnes
ttgggtccccagatcgacgtggatacggcaggcggctgccatgcgcagcagggagccgatccagccgaaaacggggcattctccgggcatcccagagaccttgatcgttgaccaccagtttttcgcgttgccgtagaactggcggtactcgtcgatgaggaccagcacgcgggtgaagtcggtctcgcgggccccttcttcttcgatgcggcggtagcggtcctccatgagagaccacagccagtggatgagggcgacctggtcggggacggtagtggcgaccatctcgatgttgggccactcccgcaggcccaggtactcgatgcgtttagggtcgatgacgaagacgcgccagttgcggcgggcaccctcgacggcgtcgccgatcatggacaccgtttttccggtacgggtgcggccggccttgagctggtgggccatgacaccggagatgtcccagaaacaggtgttgccgtcctcgtcgacggcctgggggattttctcccagtctggggagtctgggcccggaagggccacgggtcggggcaccatcgagggcagggggtggcggcgggtgacggtgatggtgtcgtgttccaggtcgaagtcgctgcgccactggccgagcatcatcgccgaggtcaccgcggccaggcgcaattggatgttcgggctggacaaatgggcgccacgttggtggtgaatggtgaagccgtccaggttcccccgatcggttttccaggaatcgacggtgaccgccgacccatagatctgagtggctacttctttagcccgttccttgtctcggtccagatcggttttgtcagggtcaggggtcggggcgcggtattgcaggacgaaccggccggccgggatcgttgcggatgtcaccgtgaactctgccggcgaccaggcagccgcggccgcctgggtgagggccattggcatggtctcgacggcagcctcctcgggggggatggtgagggtcaggcgtcgcggatgcgtcttcttgcgattccatgtgactttctgcctcaccggcaccttcgccgccgactgaatggctaggcgagctgattcggcagtttcggtacgccggccagcgcgtagcgcccgtcgtgcgtgaaggctgcccaccacagcacagcccatacacggcagccaccagcgcggatcagcggctgctgcatagcccccggtagctagtaccgcacctgaccagccggccgcgatacttttccacgccggtttcgcgccaccaggaccagcgttatggacggtctgcttcgaggctgcggagggacgagacagcggagtgctggtcatgctgcggcctccttgtggcaggtcatttcacaggcatgccggccagcgatgatgccgtggcgcaccgccccggtagccgcatagaccgcgcacaactcaaacacggggcacccatcgcaggccgccggatccatgctctctttgtcccacgatggtgggtcatcggtgcacggcacggccaggccatcctgttgagcggcgctgatagcggtgaataggcgcagctgggcgcgaacttggtctggggtcaggttgacggtgcgggctacacgcatggggttccttcctcttcaccagtgaaggttccctagacccggccgatgtgcggagggatttcagtgttttatcgaggtgaccagccagccggtctgcgctgcgggttcaggtaccagggtcagatgcagcatggtgtggtcggctaggggcacggcgaccaggggcccgtcggcgctcgccccggtgagggtgggagttccggccacggtggtggcaggaatctggttgggtttcgcggccatcagggagcccatgagggtcggtgcggcgatctggacgagggcgactttgcgggcggcgggatcgcgggtcaaccagccgcgggtgaaagcgagcgccgccgacgtgatatcggggctcagcggggctggagtggcggctgggtgggccgttgaggagggccacacgcgcggtagcg

SEQ ID NO: 224 - DNA, 8643 bp, Propionibacterium acnes
caacgctggattcggcgatggtcacccattctccgtcgatattgatgagcaccccagcggccagctccgtggcagcaaccgggtgaggtgggttgtagaagcggtcgatgtcgcaggcagggtcgtcgggttcctcgactaccggaggtggggtcgatctggctgtctcggtgtcgtcggccaggtcggctcccaggatgcgctcccattcggggctggttttcttgcccgctgaggccatcgtctcgtcgatctgttcgtcagtgggccacacaaatttctttttggtccaggtcgtggtgtcgggtcgcagctgatccagcagttccaggtcttgcggggagtgggccttgcgggggtcgggggtgtagaagaattggacttccttgggggctgattcgccggataggtaggtgccgcggccgcgtttgccgaacgggatgcccacgccgacgtgttcggagccgaacatcatgcgggctccgtcagcggacaggggtccggtggcggcacgcccggagaagttgtctcggatttcgccgcccaggaactcggcgtcggggcgttgggtccccagatcgacgtggatacggcaggcggctgccatgcgcagcagggagccgatccagccgaaaacggggcattctccgggcatcccagagaccttgatcgttgaccaccagtttttcgcgttgccgtagaactggcggtactcgtcgatgaggaccagcacgcgggtgaagtcggtctcgcgggccccttcttcttcgatgcggcggtagcggtcctccatgagagaccacagccagtggatgagggcgacctggtcggggacggtagtggcgaccatctcgatgttgggccactcccgcaggcccaggtactcgatgcgtttagggtcgatgacgaagacgcgccagttgcggcgggcaccctcgacggcgtcgccgatcatggacaccgtttttccggtacgggtgcggccggccttgagctggtgggccatgacaccggagatgtcccagaaacaggtgttgccgtcctcgtcgacggcctgggggattttctcccagtctggggagtctgggcccggaagggccacgggtcggggcaccatcgagggcagggggtggcggcgggtgacggtgatggtgtcgtgttccaggtcgaagtcgctgcgccactggccgagcatcatcgccgaggtcaccgcggccaggcgcaattggatgttcgggctggacaaatgggcgccacgttggtggtgaatggtgaagccgtccaggttcccccgatcggttttccaggaatcgacggtgaccgccgacccatagatctgagtggctacttctttagcccgttccttgtctcggtccagatcggttttgtcagggtcaggggtcggggcgcggtattgcaggacgaaccggccggccgggatcgttgcggatgtcaccgtgaactctgccggcgaccaggcagccgcggccgcctgggtgagggccattggcatggtctcgacggcagcctcctcgggggggatggtgagggtcaggcgtcgcggatgcgtcttcttgcgattccatgtgactttctgcctcaccggcaccttcgccgccgactgaatggctaggcgagctgattcggcagtttcggtacgccggccagcgcgtagcgcccgtcgtgcgtgaaggctgcccaccacagcacagcccatacacggcagccacgagcgcggatcagcggctgctgcatagcccccggtagctagtaccgcacctgaccagccggccgcgatacttttccacgccggtttcgcgccaccaggaccagcgttatggacggtctgcttcgaggctgcggagggacgagacagcggagtgctggtcatgccgcggcctccttgtggcaggtcatttcacaggcatgccggccagcgatgatgccgtggcgcaccgccccggtagccgcatagaccgcgcacaactcaaacacggggcacccatcgcaggccgccgggttcatgctttctttgtcccacgatggtgggtcatcggtgcacggcacggccaggccatcctgttgagcggcgctgatagcggtgaataggcgcagctgggcgcgaacttggtctggggtcaggttgacggtgcgggctacacgcatggggttccttcctcttcaccagtgaaggttccctagacccggccgatgtgcggagggatttcagtgttttatcgaggtgaccagccatccggtctgcgctgcgggttcaggtaccagggtcagatgcagcatggtgtggtcggctaggggcacggcgaccaggggcccgtcggcgctcgccccggtgagggtggggggtccggccacggtggtggcgggaatctggttgggtttcgcggccatcagggagcccatgagggtcggggcggcgatctggacgagggcgactttgcgggcggcgggatcgcgggtcaaccagccgcgggtgaaggtgagcgcagccgacgtgatatcggggctcagcggggctggtgtggcggcggggtgggccgttgaggagggccatacgcgcggtagcgctggcgacatcgagcgggtcggagtggggtcaggtgtggggcttagggtccgatgtggcgatggggctaccgccccggtggtgggagacgagactggttgggggtggtgttgagggcgtgggatcagggtgaaggcagccaaactggccgggatgaggatgacggccgcgccgacacttcggagcgaggtcatgtgacgatccttcggtagctcgacgggttgccgtagatcttttccacgttgatgccactatgtgggttgtcggcgctaaccatttggcctccaccgatgtagacggccacgtggtgggcagggcttccccagaggatgaggtcgccgactttgagctggtcacgggccacagcagtgccgactttctgctggtcggcggcggtgcggggaaggctaatgccgatacgccggtacagcgccgaggtcaggcctgagcagtcgtagccgccatcggctttgccgttgccaccccacacgtaggcgtaggagttgttgtcggcgatcgatttggcccatgccacggcttcggccaggttcttcgacacaccggtctcgttagcggccccggtggcacagttgtttgacaggtgccctgtagtagtggatcccactatttgtttggccatggtttcccatttggcgtaggcatcgggcagggctgagccttgcactgcctgagctgcctgcgtcagcggcatcttctgccagtcagcgatgtcgactaaaccgggaatgtggaatccagggccgccggccgatccggggccagcgtaggtgatggtgtggcctttcaagaacgcctcggtggcgtaggcatcattgttgacctgatccagagtcccgtaccagcccggcaggatgcgctgctgaaaggggccggcgtcaccgtcaccgttagccttcgctgaggtagggtcggccccaagatctgattcttgtttggcggtcataatagcgatgaccgctgcctgggtaggcagtttgtcacgctggaccacagtgacgatggtggtcacgagctgcttctgcctggccgtgaggcctccggcacccacagtgcctccggtgacggtacccacgcaagcatccccgccgacactgccaccgccgccgccagagttgtcgtcgagggccccagagcctactgacagcagcggcacaatgatcacggtcgcgggcaagaccgccaggcccgccagcatcagcactgctgcactcaccacggcgatcacgtgagatgctttcaacgctgcccacctttcgctggtttgagggggcgacgcctgctggtacgcacaggcttggttggtccagtccgccgttggttggcaggcctgggtttgatcggcttgctgggacccggtttgggctccggagtcttaggctccggcttcacatgcctaggcacttcggctgcggtgggaggagtcagcacgtggcgtaccggcttggtgaccttctgggcacccgaaacaaccggcttagacaccaccttggcacctttgaccaccggtgcggctgccttcgcgccggccttcttgactgcacgatgcgctttgatagccccggcctcggcccggccaaccctgctagcagtagcatcgagggctctgtggcccgtcgttgccctcaccggtgcatccttgccctgacgggcctgcttcgcgatcatcgacataccgccccgcaacgccgaaacacggttgtgagcgtgggcgacggccgacataccagctgtcgtaattttcgactggccctgcggagctcctcccccggtacggatctgacgatatgacgccgaagcacgccgcgccgccgaggccattcgcgccatcttcgcagcccgggtcactcccaccgacgcgccaccggtgactaccgcagccgcagccgaaaccatccgccttcgacccaatccagtgagcttgcgaccaccgctgcgcaccatccggcgagcaccccgcccagcccactggccaatcgccgacgccccttcagagcgcttactacgcatccagtcgttgatcttggccctcagcccctcctcacccttgtgactacgccacagagacaccaagaatccgatgattcccacgatttccaacatgttgacgaccatgaccttgatgacaacgttgccatcagaggcgaagaccgacttgatgacgagcatgaccacgcccagcatcaccatcgacccaacaatgccgatcatcgagtacaagatcgaacacagatcccggataagcgggtctgtgcgaccaggaatagcccgcagcacgttgagcatcgacatgaacgccgaccacaccaacttgcacacgtagaaccagcacatgcccgcgaacaccagcaggattgctgccaaacccgtcaccgttgacgagtaaaagaagaaccccaccaaccaggaaccgtccgcaatatcgccggcgtaatccgataatccctcgtcacaatcaccgaggtcgtcgcgtgcatccgagatatcgtcgtaaggaccacctttgagcacctcgatgtacttgtcgtgacatttggaatcaataatgcggccgtagttgagttgctgatgaaccggcgccacgaacgagtccacaatgatcgccgacagcttcggatccttcgagtctcccgtcgaggtcatgtcatcaggaatctcgacctcaccagcggtcgccgtcgcaggatcaaccgaactggtaatcatatgagacagcgccacaccgaactgctgggtgcgagccagcggagtagccaacgtcgtcgtatcgcctgcgaacttcgccaccggggccgccaagaaacccaacgccagcgccgcagcaatcgccgcacgcgcacccgtagcccacgcccctgccgtacgtcccctcatcatcttgacgaccacgcccacaccggcgcacgtcgtcagcaacgtcaacaccgttccaccccagctgtccgctcccagcggggccaaaaccttgtcgtggatgtcgttctgtaaccccaccagcggtccggtaatccacccgacccagctcatcgccacggtccagtccaacaaccggcacaacagggcaatgaccatcaggtacgtgttccaacacatgccaataatggaggcccacatagccttcagcggggccgtaacgccaccatcgtccatcgacatctggtactgaaacaagtgaataccgttggagtcagtcacattgaaaccgtcacccatccagcccagccccgggcccgatgccatggcaggcacactgctcagcgccaccaccagaaccagcgtggtgacgatgatacggaaccaccgctccccggttccggggcggcgtggatgacggctcacgctgtctcctggtcgtgctcgggcgggttggagctggcggcttcgcggtggggagcgtaggcaggtctcagtagtcgaatttcaccgacgttgccgtgttggtcggcgtacaggccacaaccggggcctccggggttgagggcaatcttgaccaggtcagcgaactcttcaggggacgttttagggtccacgcccaggaactcgacacctttctgggcgaggttgatgttgtcgcacagcaacacgatgcgatgctgaatgaggttgcggacggtctcgttggggtaatcggcctcggggtcgtgggagccagtaatgagccaggcgttggctcggcgggactcacgcacgtactcgtcgatggcgtgggaggcttccggcgaggacgacatgtgatgaaactcgtcaacaatgaaagcggcgtcgcgggcccggtcgctgaagcacaccaggcgagccagacgggcaatgagcgcgtagagggctcggccaaacaccttgtgcgggggcagctgccgaaacagatgttctgacagcatctcctcggcgttaggaagagcgatgccacaagtgccaatgatgaggatgtcggcactcaggtcggcgggaggaaggtccgggtcaaagatggccgaagctagggaggccgagttctcgatgtcagcgaacacggcaatccggtcggcgatcgcggtggcctcgggaaggtcgcattcctcggccaggtggcgggccagacgcccacacgaggtgatctggtggtcacgcatgtaggccggtttgaggaccttggccagcgtggtcccggccacaccgatggtctccaagttaagcaaggtcagcaagaacgactgggcgacctgcccggccatctccgggggaaggatgcgcagcgggtccagcgacagcttggggtgggccgtgtcgacgatctggcgtctaaccccgtcgatagagttgacaaaggttacccactcccgctcatcggagttgtcggtggcaataatgcgcccgccccgggccgcgatggctgcgcacagccgcttctcggccatcgtcttgcccgcgcccatcttgccgatgaacgccaccgtgttgcctttctgatcctgagtgtcggcatgcaaatcgaggtaggccagcgactgcaacggggagcctgtgaccacagccaacgggatgccggtggtacggcccaaccggtactcaaccaccgggatagatgcggcgaacgcggaggcgtgagtcagctgacggtaggcgttaagcgaggaggagaaccggccaccgggccgggcagcccacagcaagtcctcctgacggcccacgggacgcacccacgtgaagtcaccgaacaccggatcattgacgaacgctcctgccagctcctcggtggtctcaaagtcaggagacgagacagtgacggtgataagagcctggatctcgacctcacgctcatcggcggccagctcggcgttgtagtcgacgagcacctgagcggaatgctcgatagacatgagggtcgaagcctgggtcatctcaccgccctcgacgttgtcgagctggtcgacggtttggcggatggcccgctgatttttctgcatcgcagcgtgacgggtccgggccactccccggatcgccacgtcgaccggcacgccagtgtcgtcgatacggcccaaaaactcgtaggcaggccacgtcatcgtgcggggcaccttacccagcacgatatgggactggtagacggtctcgccggtgtcggcaccgattttgaggacgcgacgattccacgcctgagccgtccgggacatgtgggagactcgcttgtcatcctcgctggccagcaggtcggaggtcgcggcctcatcgatgaccaactcccccagcgcggcacgtccaacctcatccatgagggcgattccctcgccaggggcatcatcacgcaaccgggtcgggtggcctgacaggtgctgccgaagccagatctgttcatcaacggtgaccgggcggggttggaacgctgccggcagtttcgcaccgaattccttagcctgacggagggcccactcccgtgcgacacggccaggagcggtggtcatgagtccggcggcttcggtgattttgttgagggcggcggtccaggcggtgtgggtgcgtattttctggtcttggttgagtttgatcgataggaaccacacgcgccggcctagggattcggtttcaggctggtcgagggtggcgtcgatttcgtcggcccacacggggtgttcgctcaggtcaaggccggcggccatggcgtcgacgatttctgtggggtcggtccaggtgagggctccgttgaggcagaactcgtggcgggcgaggtggcggaataggtcgcggtgagctgcggcgacggtgagggaggcgttctcggtgacgggtcgctggaggggagtgagtcgccaggtggcccagatgtcgccggtggaggtccagacgaggttgtcgaagaggaaccgttcggggatggacatcatgactccttttcggcggcggcgaggaaggcttccaggccgctgcggcgtacagcgttcccggtagggtgcaggggttttctgggggtgggttcaggtttcgggtctgggaggggtttgggctcgtaggtggtgtcgatgtcttcggcgaggacgtggtcgagcaggcaggtggccggggtgtcg

SEQ ID NO: 225 - DNA, 8232 bp, Propionibacterium acnes
gggatgaggatgacggccgcgccgacacttcggagcgaggtcatgtgacgatccttcggtagctcgacgggttgccgtagatcttttccacgttgatgccactatgtgggttgtcggcgctaaccatttggcctccaccgatgtagacggccacgtggtgggcagggcttccccagaggatgaggtcgccgactttgagctggtcacgggccacggcagtgccgactttctgctggtcggcggcggtgcggggaaggctaatgccgatacgccggtacagcgccgaggtcaggcctgagcagtcgtagccgccatcggctttgccgttgccaccccacacgtaggcgtaggagttgttgtcggcgatcgatttggcccatgccacggcttcggccaggttcttcgacacaccggtctcgttagcggccccggtggcacagttgtttgacaggtgccctgtagtagtggatcccactatttgtttggccatggtttcccatttggcgtaggcatcgggcagggctgagccttgcactgcctgagctgcctgcgtcagcggcatcttctgccagtcagcgatgtcgactaaaccgggaatgtggaatccagggccgccggccgatccggggccagcgtaggtgatggtgtggcctttcaagaacgcctcggtggcgtaggcatcattgttgacctgatccagagtcccgtaccagcccggcaggatgcgctgctgaaaggggccggcgtcaccgtcaccgttagccttcgctgaggtagggtcggccccaagatctgattcttgtttggcggtcatgatagcgatgaccgctgcctgggtaggcagtttgtcacgctggaccacagtgacgatggtggtcacgagctgcttctgcctggccgtgaggcctccggcacccacagtgcctccggtgacggtacccacgcaagcatccccgccgacactgccaccgccgccgccagagttgtcgtcgagggccccagagcctactgacagcagcggcacaatgatcacggtcgcgggcaagaccgccaggcccgccagcatcagcactgctgcactcaccacggcgatcacgtgagatgctttcaacgctgcccacctctcgctggtttgagggggcgacgcctgctggtacgcacaggcttggttgatccagtccgccgttggttggcaggcctgggtttgatcggcttgctgggacccggtttgggctccggagtcttaggctccggcttcacatgcctaggcacttcggctgcggtgggaggagtcagcacgtggcgtactggcttggtgaccttctgggcacccgaaacaaccggcttagacaccaccttggcacctttgaccaccggtgcggctgccttcgcgccggccttcttgactgcacgatgcgctttgatagccccggcctcggcccggccaaccctgctagcagtagcatcgagggctctgtggcccgtcgttgccctcaccggtgcatccttgccctggcgggtctgcttagcgatcgccgacatgccgcctcgcaatgccgaaacatgattgtgggcgtgggcgatcgccgacatgccggccgtcgcgatttttgactggccctgcggggcccctgccccagcacgaatctgccggtaagccgccgacgtgccacgagcacccgccgccattcgcgccaccttcgcagccctagtcactcccgtcgacacgccacccgtggctaccgcagcagcacccgagaccacagtcgaggccatccgccttcgacccaatccggtgagcttgcgaccaccgctgcgcaccatccggcgagcaccccgcccagcccactggccgatcaccgagcccctttcggaacgcttgctgcgcatccaatcgttgatcttgtccctcagccccttctcgcccttgtgacgacgccacatggacatcaagaacccgataatccccacgagctcgagcatgttgacaaccatgaccttgatggcgacatcaccgtcagaggcgaaaaccgacttgatgatgagcatgaccacacccaacatcaccatcgacccgacaatgccgatcatcgagtacaagatcgaacacagatcccggatgagcggatctgtgcggccagggatagcccgcaacacgttgagcatcgacatgaacgccgaccacaccaacttgcacacgtagaaccagcacatgcccgcgaacaccagcaggaccacagccaaacccgccaccgtcgacgagtaaaagaagaaccccaccaaccacgaaccatccgcaatatcgccggcgtaatccgacaacccctcatcacagtcaccaaggtcgtcgcgagcatccgagacgtcatcgtaagggccacccttgagcacctcgatgtacttgtcgtggcacttcgcatcaataatgcggccatagttgagctgctgatgaaccggcgccacgaacgagtccacaatgatcgccgacagcttcggatccttcgagtctcccgtcgaggtcatgtcatcaggaatctcgacctcaccagcggtcgccgtcgcaggatcaaccgaactggtaatcatccgagacagcgccacaccgaactgctgggtgcgagccagcggagtagccaacgtcgtcgtatcgcctgcgaacttcgccaccggggccgccaagaaacccaacgccagcgccgcagcaatcgccgcacgcgcacccgtagcccacgccccagccgtacgtcccctcatcatcttgacgaccacgcccacaccggcgcacgtcgtcagcaacgtcaacaccgttccaccccagctgtccgctcccagcggggccaaaaccttgtcgtggatgtcgttctgtaaccccaccagcgggccggtaatccacccgacccagctcatcgccacggtccagtccaacaaccggcacagcaacgcaatgaccatcaggtacgtgttccaacacatgccaataatggaggcccacatagccttcagcggggccgtaacgccaccatcgtccatcgacatctggtactgaaacaagtgaataccgttggagtcagtcacattgaaaccgtcacccatccagcccagccccgggcccgatgccatggcaggcacactgctcagcgccaccaccagaaccagcgtggtgacgatgatacggaaccgccgctccccggccccggggcggcgtggatgacggctcacgctgtctcctggtcgtgctcgggcgggttggagctggcggcttcgcggtggggagcgtaggcaggtctcagtagtcgaatttcaccgacgttgccgtgttggtcggcgtacaggccacaaccggggcctccggggttgagggcaatcttgaccaggtcagcgaactcttcaggggacgttttagggtccacgcccaggaactcgacacctttctgggcgaggttgatgttgtcgcacagcaacacgatgcgatgctgaatgaggttgcggacggtctcgttggggtaatcggcctcggggtcgtgggagccggtgataagccaggcattggctcggcgggattcgcgcacgtactcatcgatggcgtgggaggcttccggcgaggacgacatgtgatgaaactcgtcaacgatgaaagcggcgtcgcgggcccggtcgctaaagcacaccaggcgagccagacgagcaataagcgcgtagagagcccggccaaacaccttgtgcgggggcagctgccgaaacaaatgttctgacagcatctcctcggcgttaggaagagcgatgccacaagtgccaatgatgaggatgtcggcactcaggtcggcgggaggaaggtccgggtcaaagatggccgaagctagggaggccgagttctcgatgtcagcgaacacggcaatcctgtcagcgatcgcggtggcctcgggaaggtcgcactcctcggccaggtggcgggccaaacgcccacacgaggtgatctggtggtcacgcatgtaggccggtttgaggaccttggccagcgtggtcccggccacaccgatggtctccaagttaagcaaggtcagcaagaacgactgggcgacctgcccggccatctccgggggaaggatgcgcagcgggtccagcgacagcttggggtgggccgtgtcgacgatctggcgtctaaccccgtcgatagagttgacaaaggttacccactcccgctcatcggagttgtcggtggcaataatgcgcccgccccgggccgcgatggctgcgcacagccgcttctcggccatcgtcttgcccgcgcccatcttgccgatgaacgccaccgtgttgcctttctgatcctgagtgtcggcatgcaaatcgaggtaggccagcgactgcaacggggagcctgtgaccacagccaacgggatgccggtggtacggcccaaccggtactcaaccaccgggatagatgcggcgaacgcggaggcgtgagtcagctgacggtaggcgttaagcgaggaggagaaccggccaccgggccgggcagcccacagcaagtcctcctgacggcccacgggacgcacccacgtgaagtcaccgaacaccggatcattgacgaacgctcctgccagctcctcggtggtctcaaagtcaggagacgagacagtgacggtgataagagcctggatctcgacctcacgctcatcggcggccagctcggcgttgtagtcgacgagcacctgagcggaatgctcgatagacatgagggtcgaagcctgggtcatctcaccgccctcaacattgtcgagctgatcgaccgtttgacggatagcccgctgatttttctgcatcgcagcgtgacgggtccgggccactccccggatcgccacgtcgaccggcacgccagtgtcgtcgatacggcccaaaaactcgtaggcaggccacgtcatcgtgcggggcaccttacccagcgcaatgtgggactggtagacggtctcgccggtgtcggaaccgattttgaggacgcgacgattccacgcctgagccgtccgggacatgtgggagactcgcttgtcatcctcgctggccagcaggtcggaggtcgcggcctcatcgatgaccaactcccccagcgcggcacgtccaacctcatccatgagggcgattccctcgccaggggcatcatcacgcaaccgggtcgggtggcctgacaggtgctgccgaagccagatctgttcatcaacggtgaccgggcggggttggaacgctgccggcagtttcgcaccgaattccttagcctgacggagggcccactcccgtgcgacacggccaggagcggtggtcatgagtccggcggcttcggtgattttgttgagggcggcggtccaggcggtgtgggtgcgtattttctggtcttggttgagtttgatcgataggaaccacacgcgccggcctagggattcggtttcaggctggtcgagggtggcgtcgatttcgtcggcccacacggggtgttcgctcaggtcgaggccggcggccatggcgtcgacgatttctgtggggtcggtccaggtgagggctccgttgaggcagaactcgtggcgggcgaggtggcggaataggtcgcggtgagctgcggcgacggtgagggaggcgttctcggtgacgggtcgctggaggggagtgagtcgccaagtggcccagatgtcgccggtggaggtccagacgaggttgtcgaagaggaaccgttcggggatggacatcatgactccttttcggcggcggcgaggaaggcttccaggccgctgcggcgtacagcgttcccggtagggtgcaggggttttctgggggtgggttcagatttcaaatgtgggaagagtttgtggatggtatcggtgtcctcggcgagggcttggtcgagcaggcaggtggccggggtgtcggtagtctcgtccagctcgtcgatcatctcgtcgaggaggttgggggtggtggatgcggcccacacaggtgggatagccggtgcgggtcgaggcggtgtggggaggcggagtttggtttggccccagaggggtgtgtgggtcatgccggcgggagtggtggcggcgtgagtggtcacacgccaccagcccgccagccatgccagaggtgaccaggtccagtcgatgcgaccaacaacgaactgggcgagccatccggcagccagcgcgaaaatgaaaccgcggatggtcatgcccccgtcgataattttgaagcccatcatcgcggcaggaactacgccgccgacagcgagcacctgatagatcgtgtagggcccgccaggaatccttcgacccgaagagtccttgccgatgatgcggggctgctggcgggcctcggtgtgccactgaatatccacgatcagctcttgcccaatccttgcatcatctgtccgaagaattggatcgcgttaccttcgataagccagtacgccataccacacacaaacagcatggagacgatcttggccaggctcataccgtgtttgaagatgttgaacgcggcaatgcccacgactacgaccatggcgacggctcgcaccgcggacttgccttcacctgccttgatcgtcgtccattcgaagaggttccgtgtttccagtggcagcaggaggaattgatcgagcatgagaggttttcctttcaggaagccgaccgggatggtcccggtactgacgggctgggcgacacgggtgtgccgtccggaggcagaaggcgtgacggctggtcgagggaggcaacctcccagcggcctgcacgactgacaagagtcaggccgtactggctagtccgggtagtggattcgtcaccggttagctggcatgtcacggtcgcggtgacagcgatcttctgccgatctgagggggtggggatctcgtcaggccccaccacatgagtggttttcaccgatacacacggggctgggtcaatcgccgtgaaagcggtccccgggctactccatctcgacaggtcgtcgctgccactcagcatcgcggccaagaaacccgaagaggtctgggcagccgggtcagcaggacgaatctccgaggagtccacgtcgggggctgaggccggtgcaggcatggggatctgcccaggtagacgcaaggcgatggccttgccgttggaatcgacgtggaccgggactgaccaggcctgtccgctcccggattggccgcccatggtgaccacggtgacctgccacaggctcggatcagacggggagacggtagcgtcataggcggtgacggtggtgggcgctggaccaggtttgcggggcatgcgcgcatcggtgatcttggccgccaccaggtgttccagattgtccaagtgcccggagtcagaggtcagcagaagagtagtcacctcgaccgcggtggctgaggcgatctgagctgtgcggcggtcgtgatgggtggtgtcagtgctgacagctgtggtgggagcggatgccggggccgccgaacggaccagggcaacggggccgcatgcgactccgcacagcacgagggcaaggaagcctttggtggccatcgatccggtgtggggccagggacccacgttttcctgtgcctgttttttcttggccgaccaacggcgggacttagggttagcggatgcaccttctggggtgcatgctcgtctcaatcgcatcggtcacctccttcactggatgaagggaccaaggaggtgaccgatgtgcggtcgaacccgaaaaagttcaaacttttttctgggtctgcctcaagtacgacagaaggcctgcatcatcacggcgttgtggtagcagatcttgcgtcagcgcaaatgtatgggcctcgtaggagtagctcttaggtgggtcccggtggttgcggccagggcgagggtgtcgggtatgtgtagcgctagtcccgggttcgtggtgtgagggcttttgggtgctgacatgcactacccattgctagacgctgtgctgtggcatggctggacgtctagcagacgggttgacatcacctttaggctggcagcgcccgaggccgcaggccagaggaagcggacagcctaacgattgacgtccccctctcctttccccaacctcctggagtcgatgacccggagatagatcgatgtctatgcatcggtgcatcgatatacctatgtatctgtctgtggtttttagaggccaccccccgtcgccccgggccgctcagcgataccgcaaggctgtgtgggatcagct

SEQ ID NO: 226 - DNA, 4813 bp, Propionibacterium acnes
ccgaaacgttccagcccgccctgttcgagctagccgactgcgcatgagaccccacacaaacatggttgaatcgaagggctcagccagcagccagttaccaggagtccccgtgcgtctataccgcgctgttcttacccacaccgacatccagatcaccgtccgcatctggagcaccaccgaccacgactggacctggactcccctcgacacctggacccccgacccgaccccgaccacaccagcccagttagccgacgaactccaccgacacggatggaccacccccgaggaccccaccaccctcaccaaggtgactgtgatccccgagaactggcaggccctcgtcgaccacgccctcgctgcccgaaaccaccaagccaaccagctgcgcgtcgccgagaacatcctcaccgacatcctcggcgacgccgccgacgccggcctgtctgtcaccgctctcgcccgcacgaccggactatcccgagtcgccgtctacaaacgcagcgccaaaaccatcgactccatgagacacgccacccaggccggcggaatcctcaccccctcctgtctcacccacgctgagagaacagcgctcggcctgcccgacgagtaacccatcgtttacatcctcgactggtccctgcgaccagtgaaccgtgcccccactgcgcccacaatgatcagcacacccacggcgaccaccaggtgggaagcactaactgatcccaacgaaccaagatcaaacaagccctgcccgggagcgtcgagcagtccgtgggcgcgaagccatgctccgagattgccaatgatcttggggatcatcttgttcagtagggctatccctccgatgccgacaacgaggaagacgaggatttcttcgcctgcgttgtttcttcctgtgtttgcggtcatgctgccttctcggggtggatggccagccagctgatgaggttgtcggtgatctgccctgagatttggatcagttcgacttgcccggcctgccatgcccgcgatgtgccggccagcaatgatgctgggacccctactgcgcggccacgggatgcaacctcagccaaggcggcgcgtaactcctcgacggtgctttcgatgtaccaactgccgtcagtactagtctcggtggcgtcggtggtagcgataagagcatcggtgaggtcgtcgacggcgcggtccagatcagcgatgtccggtagggctacagcagtcatggtgtgtcttccttctagggtgccttcactggtgaagggtccctagccccggccgatgtgcggtgctgtgggaaaaatgcttcccattggtccgtcttagttaggaaacttggcctaagtgctgtcgagggtcgcgtgttcgtgaccggttcgaagacactgccgctttgccttcttgcccgtggcgcttccgagatgggttcagtgggcgatggctaggccgatgagggcgccgctgcacaggctgggtgcccaggggaggaatcgggtggtgtggtgtcggcagcggtcgatgagggcatatagggcgatcagggtgaggccggctatgaccgtggcgtggatcgtgtcgatgccggttgctgcggccggggctgcccacagtggtgtgatgcgcacgtcggagaagccgaagccgcctcgggagatgagccaggcgatcatccacgccgcggagatgacgacagtagcgatagcagcacggatcgccgcagtctggttcgcgagagcgatcatggccacagccccgatccatccaacccagccggtccaggcgaggactgccggtatccatgtggtgatggcgtcgatgacggctacccatgccccgatggtggctagcagagcccaggccggccaggtgggtgctggggcccacgctacggcggcgatcatggttgtcgcagatgcagcacagacagcgatcatgcttcggagactgtaggtgtcgcggtaggcgattttgtcgggggtggcggtggccggttcgggcaggatgcgagtgagggagggccatcctgcggtcgcaatggtcacgacggcggcgatccacacgatctggtgcatgggtctcatcatggcccaatatcgatgggtgtgggtggccgacatgggctcagtcgtcaagaggtgtacgggcggttgtggcttcttgggtgccgagcatgagggtgccagaatcctcgccggctgattcccagtcgacgatgacctggtcgccgtcaacgctggattcggcgatggtcacccattgcccgtccatatcgatgagcatcccggcggccagctctgtggcggcaaccgggtggggtgggctgtagaggaggtcgatgtcgcgggcagggtcgtcgggttcttcggttacctcgggtggggtcgatctggctgtctcggtgtcgtcggccaggtcggctcccaggatgcgttcccattcggggctggttttcttgcccgatgaggccatcgtctcgtcgatctgttcgtcagtgggccacacaaatttctttttggtccaggtcgtggtgtcgggtcgcagctgatccagcagttccaggtcttgcggggagtgggccttgcgggggtcgggggtgtagaagaattggacttccttgggggctgattcgccggataggtaggtgcctcggccgcgtttgccgaacgggatgcccacgccgacgtgttcggagccgaacatcatgcgggctccgtcagcagacaggggtccggtggcggcacgcccggagaagttgtctcggatttcgccgcccaggaactcggcgtcggggcgttgggtccccagatcgacgtggatacggcaggcggctgccatgcgcagcagggagccgatccagccgaaaacggggcattctccgggcatcccagagaccttgatcgttgaccaccagtttttcgcgttgccgtagaactggcggtactcgtcgatgaggaccagcacgcgggtgaagtcggtctcgcgggccccttcttcttcgatgcggcggtagcggtcctccatgagagaccacagccagtggatgagggcgacctggtcggggacggtagtggcgaccatctcgatgttgggccactcccgcaggcccaggtactcgatgcgtttagggtcgatgacgaagacgcgccagttgcggcgggcaccctcgacggcgtcgccgatcatggacaccgtttttccggtacgggtgcggccggccttgagctggtgggccatgacaccggagatgtcccagaaacaggtgttgccgtcctcgtcgacggcctgggggattttctcccagtctggggagtctgggcccggaagggccacgggtcggggcaccatcgagggcagggggtggcggcgggtgacggtgatggtgtcgtgttccaggtcgaagtcgctgcgccactggccgagcatcatcgccgaggtcaccgcggccaggcgcaattggatgttcgggctggacaaatgggcgccacgttggtggtgaatggtgaagccgtccaggttcccccgatcggttttccaggaatcgacggtgaccgccgacccatagatctgagtggctacttctttagcccgttccttgtctcggtccagatcggttttgtcagggtcaggggtcggggcgcggtattgcaggacgaaccggccggccgggatcgttgcggatgtcaccgtgaactctgccggcgaccaggcagccgcggccgcctgggtgagggccattggcatggtctcgacggcagcctcttcgggggggatggtgagggtcaggcgtcgcggatgcgtcttcttgcgattccatgtgactttctgcctcaccggcaccttcgccgccgactgaatggctaggcgagctgattcggcagtttcggtacgccggccagcgcgtagcgcccgtcgtgcgtgaaggctgcccaccacagcacagcccatacacggcagccaccagcgcggatcagcggctgctgcatagcccccggtagctagtaccgcacctgaccagccggccgcgatacttttccacgccggtttcgcgccaccaggaccagcgttatggacggtctgcttcgaggctgcggagggacgagacagcggagtgctggtcatgccgcggcctccttgtggcaggtcatttcacaggcatgccggccagcgatgatgccgtggcgcaccgccccggtagccgcatagaccgcgcacaactcaaacacggggcacccatcgcaggccgccgggttcatgctttctttgtcccacgatggtgggtcatcggtgcacggcacggccaggccatcctgttgagcggcgctgatagcggtgaataggcgcagctgggcgcgaacttggtctggggtcaggttgacggtgcgggctacacgcatggggttccttcctcttcaccagtgaaggttccctagacccggccgatgtgcggagagatttcagtgttttatcgaggtgaccagccatccggtctgcgctgcgggttcaggtaccagggtcagatgcaccacggtgtggtcggctaggggcacggcgaccaggggcccgtcggcgctcgccccggtgagggtgggagttccggccacggtggtggcaggaatctggttgggtttcgcggccatcagggagcccatgagggtcggtgcggcgatctggacgagggcgactttgcgggcggcgggatcgcgggtcaaccagccgcgggtgaaagcgagcgccgccgacgtgatatcggggctcagcggggctggagtggcggctgggtgggccgttgaggagggccacacgcgcggtagcg

SEQ ID NO: 227 - DNA, 1095 bp, Propionibacterium acnes
acaccgatcaagcggcctgtatcggcagcattgccgtacctctgcccggcctgatcctcaagccacgacaacgcatcccggaacaaccgcacgtcctccagggctaaaccgcagtcgtagccgcccttgtcccccaacctcacaatctggcgctcccggcgtcctcttttgtcgacctcgatccacagtttcgcgtgcatccgctggcctcggccttctgacaggatctcggtgagcaggtcggacgcctgccctcgcgcatcctcgttactgcgggggaattggagtatgtgggaggaacgacgatggggaaggttggtgacctcatggcgcagcaggttgcgcttgcgcatctgctgatcgagacgctcgggctgacctgttgacggggttgagccgtggcgccgcttcctcggcggggtctcgatccgttgctcttccggcggttcggcgtcaggttgtggtgcgcgatctcccctaggacgggggggctcgccacctatatccgagggacgatgagacggccttccacgcttgctgcgcactttcgcagcccgccccttgcggtcacatcgacgcggcggcggagtgacgtcctcaccgcgcgctagctgcgtcaacgccgacaccaggttggtgcccggtttcagcccttttagcacgaaccgcaccaggcgggggtctcggccgattcgtcgggcaatctcggcttggctccacccctcggctaacagggggcgcaacaagtcttgggcccggttatcacgctcagtcactggtcgccccctcggggagtcctgcctgctcggcctgctctgatagagcagcccgttccgatccggtctggggcgctttcaggggaccgggtaggacacctttgacacgcagccgcccgtccttgccgtcatcgccgcccccctgggccacagggagcgcccaggggggcacgttgctggtgtagatggcgtcgccgtggatagccagcagggtgcgggagttcatgcgtagtgctcctcccttggttgtggcgttttttccggtggtggggtcggcgatgggtgtgttgagggtgcgtacgcgggacagggcccagat

SEQ ID NO: 228 - DNA, 718 bp, Propionibacterium acnes
ccggggccctgctgctggtgtgggacgtcaccgttttgaccgggcccactctcggccaccgcgtgcgtcctctcagtaaggacgccgagctgactgcccggcgctggctcgaccaggtcgccgacaaccccggcttcctcgacacccttatcgaggccgcccgcatcaccgatggatggcatcacgcgacgcctccgcacattcaggccccttaccggacccttcatcagtgaacggaggtacaacgacatgaccagcgacattgacattgaccggacccacaaacccgacgaccgcgccgaggctcctctttaccggtcctgggccaggagactcgtgcacgtctccgggatgccctggcgtatcgtcgccgccttggccggggtctcccccacctccatgcaccggcttctattcggccgcaacggtcgacccgtggaatggatcggcatcaatgatgctcgcgccctgatggatatcggcatcgatgatctcgcctcagcgtccaccgaccgtatcccggcccgcgaatcccgcgagctgttggtagccctgcacaccctcggctggaccgatgagcatctaagccgctggctgaccagttccgacctcgacctggccaccacccccaaggccctctacgtcacccggctatccgccgcccgcatccaggccacctacgacatgctcatcagccagcccgtccgccgctgcggcc

SEQ ID NO: 229 - DNA, 7861 bp, Propionibacterium acnes
tttgtccacccacccctgtcgattttgtccgccaagtattagacaaaccattagacagtgaattagaccctgggtcgcgtcagcgtgtgaactcaccaacgcgcgcgcgcgcggcggccgagccgccgaagccaaagaaacccataccaccaacgcctgaaccagcagcccccgcttcagacagtcctgtgtcagcgcacgctgatgaggctgccgagttggcgtggcagttcgtggggtggtgtcctcagctggtaggggcaccgaagaaggtgcgtggccagctccgccagatggtcgctgccgagatccgccggaatccgggctggctggatgcgccagcgttggaggttgttgcccagcgggtacgtgctgaaggtgcgctgggggtccagcactgtgagattgtgcgagccgagctgcacggggtgatcgccgaccagaaggccgcccccgcccgccccgacgccctgcacgcgcgggagcccaagtggtgggacgacgtgtactacgaaggaaacacaaccgtgtggtacgactctgacgaaaccagtgacgacgacgaggcgtggaaccggtcgcaggtatgtcatgttgctgagcgtgacgacatggctggcgggattgctaccaacctgctggcctcccacgctgatgatccgatggcctggctgactcgccgtcaaaccatgctgatggctcgtttcccccacgcccagaacgaggtcatcgcgatgtgccacatcgtgcgcaccgccctggaggccgacatggccgccggaacccggtgggaggactgatgagggtctcccggcgcgccctcatggccgtggcccgtgccgacgctgccgcagcagaccatgccaccggccgatgggtggccacagccaacgccaccgtcgcccggctgaccggactgtgcgaacgcaccgtccaatacgcccgcgccaccctggtccacctgggcctgtgccgcgtcgtggccaccggccgctacctcaccgccgacgagcggcgcacggctgctcgcacccatggcggccgccagatgcgcgccgcctccacccgcgtcctcaccatgtcctgcgcaatcgtttgcgccctaccccgaaggggtcaccactacaggaaagttaagttcctagatggtcaccaacgcacgcgcaggcgcgtgcgaaggccagcaacaccagagaagaaacccctgtggctgcaaaaactcgcagccctcctcgaccagcacctgccctggctggtgagaaaccatcacatcggccgactgtgccacgccctcaccgccctgggcatcgacgaacactggcaacccgcagacctcgacgccctcctcgacgccatgaaccgcaggaaccgtcgcctcggcctcgacgtgccatgcgccgacgaccagcacaaccccttgggactgttcatccatcaggcccgagacaccctcacccacgacaacccccatgaacgccgcctagcccgtgacgctgaacgcgcccggctcatcgacgaccaactccgccgccgcgcagaaaccgccacctgcgcagcccgcctcgcagccgagcacgccgaccccgactaccagacccgccgtcgtgaacgcagggaaaccctgcgagccacactcagggccgcccagcagcatgtcaggacacactgatacccgctcatacgcacaccatgaaacacgacaagccacctgacagtatcagctgcaagacgcatgacaacatagaaggacatgatgaaatacacatagacacaaccccgcacagcagtttcgcaacaaatcatgatagtctcatggcagtatcgcttgatacacacatagcatcactcccacataggcagttatgctgatatactcctactaggttatccgtccaacatgctgagtgggttcctgtacagcatgaaaggagcatggcatgatatgggccgttctcaactgcaagggtggtgtcggcaagacgaccagtgccctcctgctggcggcagccgccgccaagcagggccacaccaccctggtggccgacgctgacccccagggcaccgcatcccagtggtcagccctggcaaccaaaaacgacgaacccctgcccttcccggtgcaagcggtcaacatcgccaccatggaggcactgcccaccaccaccgacgcccatgatctcatcctcgttgacacacccccctcggcaggcgatctgatgttccaggcatgccgcatcgccgacctcatcatcatccccaccgccacctccggacccgacatctcccgaacatgggtcaccatggacgccacacaaggcacaccacgcgcgatcctcctcacccaaaccgaacacaaccgtgtcgtctaccgccaagctcgcactgccctcgccgccgacgacaccgtcgttctcctggaccacgacatcccccgccgtgaatccatccgcacagcatggggcaccaaccccccagacgacgtcatcacctactacctgcccgtcctcaacgaactcatggaggccctgtcatgaccaccaagaaaaccgacccattcgcccgccagaaagcagcagaagaccgcgcccaccaactccaagacgaagcccaacgccacgcccaccccaaacgcgtcatcggccccaccgcacgattccagttcgtcctgccagccgacgtgctcaccggcctcaaacacctcgccctcacccgcggcaccaccgcccgccaactcaccctcgacgccctcgacaccgcctacggcctcgacaccctcgccaacagcgggaagaaaacccacccatgacccgtgggtccccctgccaccaccccctcgacggcaactgtgtgcgagccacaggcccgcacacaggcggcagcccagtgccgtccccgccaggaaaggaactgaacttttctggagtgctggctccctatcaccccttatggtgctatcagatccagtagcgccagcccgagaggaaacccatgagctacatcgtccgcaccggaaatctagccggcacccccgagctgcgcgaggggtagccgacacggcggaccgtgcccctgacagtaagcggcactactggagacatcaccatgaccgctcagatcctcgccccgtgcaaccagaaggctgccgtcatcgaaggagccctgccatgaaccaacctaccccccacaaggccgacgagtcacagacgagcaacaccacgaggaagtggcggcacaaggtgtcgttctaccaagacccggccgacaccgaccgagtccgcggagcgatcctccacaccatgacaaccgaaggcaaccggaacctgagccagttcgtcaacgatgccgtcatggccaaggtgaccgaactggaagcaaaatacaaccacggcgagccattccccgccgtgggagcccgaggactcccccagggcggcgcagccgccaacagataagagggcggggaccaccaatagcagtcgatttcggatccagatcgggtagacaggacccatgatgaatttcatatcctccctgctctcggccatcctgaccctctttgcgatggtagccgtggcgataggagtggtgaacattgtgccgggaatatgcgccatcatcggtgcacggaaatacggcgaccaggaccgtgtgcgggcaggacaacgaaagatccttcttggtgctatcgccttggtggtagcagtaggcattcacccgtgacccacggttaccggaagccccgccgcaatcgataccactgtcagtaccatcaggggcgataggggtcaagctctccttgtcacaatcccttccccggcagcccagtaaccgtcgcttacagccatacatggatatgcgcccattcgtcggcaccgacgccgtgcgggttggcgacgctgacccgtctgctcacaaacgacccttccagcccagcaccacccactacaccgacacgatccacgaagctgaaaccgaacctcccatccccgtccgaaacatcaacgaactcatcaaccccaccaaccatgcatgaacgcacgatcgcctaccggccagccttcctgcgcgacgtgaagcggctcaaaaacaagcactacaacatgaacacacactcaaatgggcggtaaggtcacgaagtcgacgtggctgcctcacggatggcttcggcgagctcttggggtcgactccacatgggccagtggccggttggcagatccatcgcggtgaagttggtcaggtgcgcgacggcgctgaacatcggattgcctgctgcggccagctcgaggacctggacgctgggaatggagcagcagatcaacgtggttagtacatcatggcgagcgctattggacagcgcgacccgtgcccgggccacttgcgcgggttcaggaaccgcccgtgcccggaaccggtcaaggtgctcgttgctgaggccctctaaactggcctgcttgccgagagtatcgaagtcaggaagtggcagctcagctgtttcctcaggtagatctggtgcgaaggcacctccatcgctcatgggaccggagtccacccagacgatccgatggaccaactctgggtgcctgtctacaactaggctcaccggcccgttcgcgccactgtgtcccaccaggaccgcatcgccgcccatctcgtccaggatggctgagatggcgtcagcttggtcgtcgagcgtgcgcgtagtgcgctgggtgtcctccggatcgaggccaggcagcgtcagccccacggctcgactgccagcagtgttcaataactcgactacctcgtcccaagcccaggctccgagccagtaaccaggaacgaggacgataggccgatgctggtcaggtcgcgatgttgaagtcatggagacatagttgcacagtgcgcggacaagggagtggcactatttctggcatgaatttagatctgggtgtccggtgaggcgatcagaacgcctccatgtactgtccgagtgtctacgatgcagcggacacagtcgagcagctggctcacaagtttccaggtgtccttctgcccctatgagggaagtcggctgctctcgcaacctttgagggctgctctggggtcggaaccagttacagatcgttcaagttccgggaactaccgccggtcacgctgattgattcccgggcgatctcgcttctgacgacagtggtcggtaaccgagaggcgtcctactctgaccccgctgctgcggtgagtaaatcacgggcgtcccggatccggccacccgtccaagtgccagccagcttgatcggctaggcatcgtcaaggagcgacgatgaggtgatgatgcgatgtgagcgcaccgcgaagtgaggtataaagaagccttcccgggcgcatgcgtcgcccaggaaggccaggttggcccctggacggctgaatggttgggcggatcaggctgtagcggagacgtgcagtacctcgtaggcgatggcgttggttgggctctggtctgcatcgtggctactgagttcgacgaggatgacggtccaggtggtgatgtcgacggcggtgacgcgggcgatggtggaatcagtggatgctgcaaggaagtcggcggttatgtcttcgatgcagtgggacggagcagtgctggtgggcaggggcacggtcttgacggtcaggcttcgggcagcagagtaatcggcggttccgttaacaagctggtggacggtccagtcctggatcgggtgccggccgaagtcgcgtacgatagccgagtaaccaagttcgccccagcagaactggcgcatcccctctatgtcgcgccagacgtagaagggcgcgtaggagttctggggtgcgcctttgaccttttcttggatgaggtaggccttgaactccagtccatggtagccgtccatgaggtgtccagtctggatgacgcggtcgcggatgatctgcatgtcatagtcggtgggcagggtgatctgatattgcatggcgtacatcagcggttctccttggtttcgtgggagtaggtcgtggggatgacgggttcctgccaatcgatggttgacaagtcgtcggcggcttgttggtaggtaaggtggatcattggctgtttgagtgcagcgccatgccagtgtctctggccggcgtcgatccagatggattcgcccttggtcaggtgctggggtgcttgtccttcaatatggaccagggcaacgccgcccgtgacgtagaggccctgtcccttggggtgtgtgcctcagcggcaaacgtgacggcgtgggcggcacgcccggcgtcttccgtggcacgatcggccggatccatggcggcgcgcagctgctgttctgcagccaggcgtccaggtcacggcgggcagcatcgacacccagggcagcctcgacggcttcagggctacgacgctggccgggctggttgaccgcagaccactggtgccgggcgtcgtccagatcatggccggcggcgtcgatgagggcggtggtggcttcggcgcagcatcgcctgatccactccgaacgtgacaggccagctgtctcggcggcactgtcaatgcgcgccaggagagatttcatgggcgctcatctgtagcctccagataggcgttgatgtagcgcagagcctgatccgtcatgtcgatggcggctgcctcggcagacgacacaacgggctgtggatgataagaccacccaacatagacggcgaacatcaatttctcgacagctttcatgaggtccccggcggcaaccgcatccgcctcatcatccgaggagaaccacttcaggtctgaacggctgtacatagcccctaggtcctgatgtgggtcgaggtccttggaatgatggaagttcctacacacccatcgccaaagacctcaacatggacaacgctaccttcaccactccctcatctgtgaagagccagtttatgcacggtgttgaaagaggcgtcggtctacgacgaatgcgggttaatggtcttgcggtgtggggcgctgggcgatggcatcgagaacgcgtgagtgggtggcgatccattcggccgcgtcggggttgatgttgcgggcgacggtgtcgatcgctgttacgtagtgggcaagcctgcgaatctcagcttgttggtcagggtgatcgctgatgagaggctcttgatgggaggcgcggttacggacgtggcggatgagctccacgttttcctcgaagtcgcgtcggctacgccccgggtagtgaggcatacctccgttacgtaagtcagtgagagctttccatacggttgcttccaggcgcggggtgagcagaaagcgccagttgtccagtgacagactcgccacgatctgatcaggggtcgcatcgagcctcgcgcgccgcagtcgcttctcggccctggcgacgttacgcgggaaaccaccgagccgatagctcggggattcccaccaacgccgtatgccagtatcggcgctcaggcgcacgtcaatgaagtttctcaggagtacctcgacatggctgatgtcttccaagaacgctttcgagatgcgggtgttccacacgtaccacgcatcgactggttcgatccggtagcggctgagcctggcgggtgagaaccactcctgcaacgtctcacgactcaccgtgggagcgtggtaggattgatgacgataggcctcgggaaggtcaatgccgcgaaatatcggtatacccccgaggtcattgttttgcccaggcccctcctcgcatacttgcggggcgtcattggctgccgtcatctcgtctcttcccggtacgtggctgtccatgttcacgggcaggtacggcaatgaggttcccgcacacaaacctctaccaagcatacgctggcaagcccc

SEQ ID NO: 230 - DNA, 7938 bp, Propionibacterium acnes
tttgtccacccacccctgtcgattttgtccgccaagtattagacaaaccattagacagtgaattagaccctgggtcgcgtcagcgtgttagctcaccaacgcgcgcgcgcgcggcggccgagccgccgaagccaaagaaacccataccaccaacgcttgaaccagcagcccccgcttcagacagtcctgtgtcagcgcacgctgatgaggctgccgagttggcgtggcggttcgtggggtggtgtcctcagctggtaggggcaccgaagaaggtgcgtggccagctccgtcagctggtcgctgccgagatccgccggaatccgggctggctggatgcgccagcgttggaggttgttgcccagcgggtacgtgctgaaggtgcgctgggggtccagcactgcgagattgtgcgagccgagctgcacggggtgatcgccgaccagaaggccgcccccgcccgccccgacgccctgcacgcgcgggagcccaagtggtgggacgacgtgtactacgaaggaaacacaaccgtgtggacgtacgactctgacgaaaccagtgacgacgacgaggcgtggagccggtcgcaggtatgtcatgttgctgagcgtgacgacatggctggcgggattgctaccaacctgctggcctcccacgctgatgatccgatggcctggctgactcgccgtcaaaccatgctgatggctcgtttcccccacgcccagaacgaggtcatcgcgatgtgccacatcgtgcgcaccgccctggaggccgacatggccgccggaacccggtgggaggactgatgagggtctcccggcgcgccctcatggccgtggcccgtgccgacgctgccgcagcagaccatgccaccggccgatgggtggccacagccaacgccaccgtcgcccggctgaccggactgtgcgaacgcaccgtccaatacgcccgcgccaccctggtccacctgggcctgtgccgcgtcgtggccaccggccgctacctcaccgccgacgagcggcgcacggctgctcgcacccatggcggccgccagatgcgcgccgcctccacccgcgtcctcaccatgtcctgcgcaatcgtttgcgccctaccccgaaggggtcaccactacaggaaagttaagttcctagatggtcaccaacgcacgcgcaggcgcgtgcgaaggccagcaacaccagagaagaaacccctgtggctgcaaaaactcgcagccctcctcgaccagcacctgccctggctggtgagaaaccatcacatcggccgactgtgccacgccctcaccgccctgggcatcgacgaacactggcaacccgcagacctcgacgccctcctcgacgccatgaaccgcaggaaccgtcgcctcggcctcgacgtgccatgcgccgacgaccagcacaaccccttgggactgttcatccaccaggcccgagacaccctcacccacgacaacccccatgaacgccgcctggcccgcgaacaccaccgcgcccaactcatcgacgaccaactccgccgccgcgcagaaaccgccacctgcgcagcccgcctcgcagccgagcacgccgaccccgactaccagacccgccgtcgtgaacgcagggaaaccctgcgagccacactcagggccgcccagcagcatgtcaggacacactgatacccgctcatacgcacaccatgaaacacgacaagccacctgacagtatcagctgcaagacgcatgacaacatagaaggacatgatgaaatacacatagacacaaccccgcacagcagtttcgcaacaaatcatgatagtctcatggcagtatcgcttgatacgcacatagcatcactcccacataggcagttatgctgatatactcctactaggttatccgtccaacatgctgagtgggttcctgtacagcatgaaaggagcatggcatgatatgggccgttctcaactgcaagggtggtgtcggcaagacgaccagtgccctcctgctggcggcagccgccgccaagcagggccacaccaccctggtggccgacgctgacccccagggcaccgcatcccagtggtcagccctggcaaccaaaaacgacgaacccctgcccttcccggtgcaagcggtcaacatcgccaccatggaggcactgcccaccaccaccgacgcccatgatctcatcctcgttgacacacccccctcggcaggcgatctgatgttccaggcatgccgcatcgccgacctcatcatcatccccaccgccacctccggacccgacatctcccgaacatgggtcaccatggacgccacacaaggcacaccacgcgcgatcctcctcacccaaaccgaacacaaccgtgtcgtctaccgccaagctcgcactgccctcgccgccgacgacaccgtcgttctcctggaccacgacatcccccgccgtgaatccatccgcacagcatggggcaccaaccccccagacgacgtcatcacctactacctgcccgtcctcaacgaactcatggaggccctgtcatgaccaccaagaaaaccgacccattcgcccgccagaaagcagcagaagaccgcgcccaccaactccaagacgaagcccaacgccacgcccaccccaaacgcgtcatcggccccaccgcacgattccagttcgtcctgccagccgacgtgctcaccggcctcaaacacctcgccctcacccgcggcaccaccgcccgccaactcaccctcgacgccctcgacaccgcctacggcctcgacaccctcgccaacagcgggaagaaaacccacccatgacccgtgggtccccctgccaccaccccctcgacggcaactgtgtgcgagccacaggcccgcacacaggcggcagcccagtgccgtccccgccaggaaaggaactgaacttttctggagtgctggctccctatcaccccttatggtgctaccagatccagtagcgccagcccgagaggaaacccatgagctacatcgtccgcaccggaaatctagccggcacccccgagctgcgcgaggggtagccgacacggcggaccgtgcccctgacagtaagcggcactactggagacatcaccatgaccgctcagatcctcgccccgtgcaaccagaaggctgccgtcatcgaaggagccctgccatgaaccaacctaccccccacaaggccgacgagtcacagacgagcaacaccacgaggaagtggcggcacaaggtgtcgttctaccaagacccggccgacaccgaccgagtccgcggagcgatcctccacaccatgacaaccgaaggcaaccggaacctgagccagttcgtcaacgatgccgtcatggccaaggtgaccgaactggaagcaaaatacaaccacggcgagccattccccgccgtgggagcccgaggactcacccagggcggcgcagccgccaacagataagagggcggggaccaccaatagcagtcgatttcggatccagatcgggtagacaggacccatgatgaatttcatatcctccctgctctcggccatcctgaccctctttgcgatggtagccgtggcgataggagtggtgaacattgtgccgggaatatgcgccatcatcggtgcacggaaatacggcgaccaggaccgtgtgcgggcaggacaacgaaagatccttcttggtgctatcgccttggtggtagcagtaggcattcacccgtgacccacggttaccggaagccccgccgcaatcgataccactgtcagtaccatcaggggcgataggggtcaagctctccttgtcacaatcccttccccggcagcccagtaaccgtcgcttacagccatacatggatatgcgcccattcgtcggcaccgaagccgtgcgggttggcgacgctgacccgtctgctcacaaacgacccttccagcccagcaccacccactacaccgacacgatccacgaagctgaaaccgaacctcccatccccgtccgaaacatcaacgaactcatcaaccccaccaaccatgcatgaacgcaagatcgcctaccggccagccttcctgcgcgacgtgaagcggctcaaaaacaagcactacaacatgaacacacactcaaatgggcggtaaggtcacgaagtcgacgtggctgcctcacggatggcttcggcgagctcttggggtcgactccacatgggccagtggccggttggcagatccatcgcggtgaagttggtcaggtgcgcgacggcgctgaacatcggattgcctgctgcggccagctcgaggacctggacgctgggaatggagcagcagatcaacgtggttagtacatcatggcgagcgctattggacagcgcgacccgtgcccgggccacttgcgcgggttcaggaaccgcccgtgcccggaaccggtcaaggtgctcgttgctgaggccctctaaactggcctgcttgccgagagtatcgaagtcaggaagtggcagctcagctgtttcctcaggtagatctggtgcgaaggcacctccatcgctcatgggaccggagtccacccagacgatccgatggaccaactctgggtgcctgtctacaactaggctcaccggcccgttcgcgccactgtgtcccaccaggaccgcatcgccgcccatctcgtccaggatggctgagatggcgtcagcttggtcgtcgagcgtgcgcgtagtgcgctgggtgtcctccggatcgagacctggcagcgtcagccccacggctcgactgccagcagtgttcaataactcgactacctcgtcccaagcccaggctccgagccagtaaccaggaacgaggacgataggccgatgctggtcaggtcgcgatgttgaagtcatggagacatagttgcacagtgcgcggacaagggagtggcactatttctggcatgaatttagatctgggtgtccggtgaggcgatcagaacgcctccatgtactgtccgagtgtctaggatgcagcggacacagtcgagcagctggctcacaagtttccaggtgtccttctgcccctatgagggaagtcggctgctctcgcaacctttgagggctgctctggggtcggaaccagttacagatcgttcaagttccgggaactaccgccggtcacgctgattgattcccgggcgatctcgcttctgacgacagtggtcggtgaccgagaggagtcctactctgaccccgctgctgcggtgagtaaatcacgggcgtcccggatccggccacccgtccaagtgccagccagcttgatcggctaggcatcgtcaaggagcgacgatgaggtgatgatgcgatgtgagcgcaccgcgaagtgaggtataaagaagccttcccgggcgcatgcgtcgcccaggaaggccaggttggcccctggacggctgaatggttgggcggatcaggctgtagcggagacgtgcagtacctcgtaggcgatggcgttggttgggctctggtctgcatcgtggctactgagttcgacgaggatgacggtccaggtggtgatgtcgacggcggtgacgcgggcgatggtggaatcagtggatgctgcaaggaagtcggcggttatgtcttcgatacagtgggacggagcagtgctggtgggcaggggcacggtcttgacggtcaggcttcgggcagcagagtaatcggcggttccgttaacaagctggtggacggtccagtcctggatcgggtgccggccgaagtcgcgtacgatagccgagtaaccaagttcgccccagcagaactggcgcatcccctctatgtcgcgccagacgtagaagggcgcgtaggagttctggggtgcgcctttgaccttttcttggatgaggtaggccttgaactccagtccatggtagccgtccatgaggtgtccagtctggatgacgcggtcgcggatgatctgcatgtcatagtcggtgggcagggtgatctgatattgcatggcgtacatcagcggttctccttggtttcgtgggagtaggtcgtgggggtgacgggttcctgccaatcgatggttgacaagtcgtcggcggcttgttggtaggtaaggtggatcattggctgtttgagtgcagcgccatgccagtgtctctggccggcgtcgatccagatggattcgcccttggtcaggtgctggggtgcttgtccttcaatatggaccagggcaacgccgcccgtgacgtagaggccctgtcccttggggtgtgtgtgcctcagcggcaaacgtgacggcgtgggcggcacgcccggcgtcttccgtggcacgatcggccggatccatggcggcgcgcagctgctgttctgcagccaggcgtccaggtcacggcgggcagcatcgacacccagggcagcctcgacggcttcagggctacgacgctggccgggctggttgaccgcagaccactggtgccgggcgtcgtccagatcatggccggcggcgtcgatgagggcggtggtggcttcggcgcagcatcgcctgatccactccgaacgtgacaggccagctgtctcggcggcactgtcaatgcgcgccaggagagatttcatgggcgctcatctgtagcctccagataggcgttgatgtagcgcagagcctgatccgtcatgtcgatggcggctgcctcggcagacgacacaacgggctgtggatgataagaccacccaacatagacggcgaacatcaatttctcgacagctttcatgaggcccccggcggcaaccgcatccgcctcatcatccgaggagaaccacttcaggtctgaacggctgtacatagcccctaggtcctgatgtgggtcgaggtccttggaatgatggaagttcctacacacccatcgccaaagacctcaacatggacaacgctaccttcaccactccctcatctgtgaagagccagtttatgcacggtgttgaaagaggcgtcggtctacgacgaatgcgggttaatggtcttgcggtgtggggcgctgggcgatggcatcgagaacgcgtgagtgggtggcgatccattcggccgcgtcggggttgatgttgcgggcgacggtgtcgatcgctgttacgtagtgggcaagcctgcgaatctcagcttgttggtcagggtgatcgctgatgagaggctcttgatgggaggcgcggttacggacgtggcggatgagctccacgttttcctcgaagtcgcgtcggctacgccccgggtagtgaggcatacctccgttacgtaagtcagtgagagctttccatacggttgcttccaggcgcggggtgagcagaaagcgccagttgtccagtgacagactcgccacgatctgatcaggggtcgcatcgagcctcgcgcgccgcagtcgcttctcggccctggcgacgttacgcgggaaaccaccgagccgatagctcggggattcccaccaacgccgtatgccagtatcggcgctcaggcgcacgtcaatgaagtttctcaggagtacctcgacatggctgatgtcttccaagaacgctttcgagatgcgggtgttccacacgtaccacgcatcgactggttcgatccggtagcggctgagcctggcgggtgagaaccactcctgcaacgtctcacgactcaccgtgggagcgtggtaggattgatgacgataggcctcgggaaggtcaatgccgcgaaatatcggtatacccccgaggtcattgttttgcccaggcccctcctcgcatacttgcggggcgtcattggctgccgtcatctcgtctcttcccggtacgtggctgtccatgttcacgggcaggtacggcaatgaggttcccgcacacaaacctctaccaagcatacgctggcaagccccgacgagacgacgcctccgcccgccacaccaacggtcaccgccacggccacggtgaccgtgaccgtggcaccg

SEQ ID NO: 231 - DNA, 770 bp, Propionibacterium acnes
taggcgccccttcggggcacctgtaagcctgtattgctgcggtttacagccttggcacccaaaggggcggcaaggggccaggaggggtcattctgcgccgctgatggcatctcacatgtgagttattctctcaactatcctttaagtcaagcgtattagattatttatccagtactcttgacagtctgtctatcgggctatatatttataagcagaacgagagatcgggaaaggaatcaacgatgaagtacaccgcacacgtcaacatggtgaccaagccctacatcggacttcccactacccgaaccccctacaccctcgtcgacgccgactgggccacaacatggatgatcgacgaaacctacgaagcccactaccacggcaccagcatggagatcagcatctacggcgaaggccccgactgctccgtactcaccaaccgcatctacaccgaccagcccaccgatgtgaccgctgcactcgccggctacggcttcaccatcgacaccaccaacacatccaaaaccatcctcacgctcacccgcacagccaccatctcccacctactagccatcctcgatggcctaccccaagctgaggggactcactggctcaacactcaacccgacctccaccacatcaccctcgacgactccaccaccggctgggccaccaaccgcaccgacgacaccgacaccggcgtctgctacgacaccagcacccacaactggcagatctgctgacagcatgacgggcctgcccttgaaggg

SEQ ID NO: 232 - DNA, 504 bp, Propionibacterium acnes
ttcatgatcgcagtgcccgatacaaggtggagcggcccacaccaagctgggccgccaccttcgttttcgggacaccctcggcaacgaggcggcgagcgcgggcaagctggccctcgctcaatgccggtttccggcctcgatagcggccctgcttcttcgccaccgcgatcccctcggcctgtcgttcatggatcaacgcccgctcgaactcggccaaggcacccagcagatgcaacatgagctggctcaccggatcagcggaccccggcccatagacctgacccccttcaagggcaggcccgtcatgctgtcagcagatctgccagttgtgggtgctggtgtcgtagcagacgccggtgtcggtgtcgtcggtgcggttggtggcccagccggtggtggagtcgtcgagggtgatgtggtggaggtcgggttgagtgttgagccagtgagtcccctcagcttggggtaggccatcgaggatggctagtaggtgggagatggtgg

SEQ ID NO: 233 - DNA, 6850 bp, Propionibacterium acnes
attttgtccacccacccctgtcgattttgtccgccaaatattagacaaaccattagacagtgaattagaccctgggtcgcgtcagcgtgttagctcaccaacgcgcgcgcgcgcggcggccgagccgccgaagccaaagaaacccataccaccaacgcctgaaccagcagcccccgcttcagacagtcctgtgtcagcgcacgctgatgaggctgccgagttggcgtggcggttcgtggggtggtgtcctcagctggtaggggcaccgaagaaggtgcgtggccagctccgtcagctggtcgctgccgagatccgccggaatccgggctggctggatgcgccagcgttggaggttgttgcccagcgggtacgtgctgaaggtgcgctgggggtccagcactgcgagattgtgcgagccgagctgcacggggtgatcgccgaccagaaggccgcccccgcccgccccgacgccctgcacgcgcgggagcccaagtggtgggacgacgtgtactacgaaggaaacacaaccgtgtggtacgactctgacgaaaccagtgacgacgacgaggcgtggaaccggtcgcaggtatgtcatgttgctgagcgtgacgacatggctggcgggattgctaccaacctgctggcctcccacgctgatgatccgatggcctggctgactcgccgtcaaaccatgctgatggctcgtttcccccacgcccagaacgaggtcatcgcgatgtgccacatcgtgcgcaccgccctggaggccgacatggccgccggaacccggtgggaggactgatgagggtctcccggcgcgccctcatggccgtggcccgtgccgacgctgccgcagcagaccatgccaccggccgatgggtggtcacagccaacgccaccgtcgcccggctgaccggactgtgcgaacgcaccgtccaatacgcccgcgccaccctggtccacctgggcctgtgccgcgtcgtggccaccggccgctacctcaccgccgacgagcggcgcacggctgctcgcacccatggcggccgccagatgcgcgccgcctccacccgcgtcctcaccatgtcctgcgcaatcgtttgcgccctaccccgaaggggtcaccactacaggaaagttaagttcctagatggtcaccaacgcacgcgcaggcgcgtgcgaaggccagcaacaccagagaagaaacccctgtggctgcaaaaactcgcagccctcctcgaccagcacctgccctggctggtgagaaaccatcacatcggccgactgtgccacgccctcaccgccctgggcatcgacgaacactggcaacccgcagacctcgacgccctcctcgacgccctcctcgacgccatgaaccgcaggaaccgtcgcctcggcctcgacgtgccatgcgccgacgaccagcacaaccccttgggactgttcatccaccaggcccgagacaccctcacccacgacaacccccatgaacgccgcctggcccgcgaacaccaccgcgcccaactcatcgacgaccaactccgccgccgcgcagaaaccgccacctgcgcagcccgcctcgcagccgagcacgccgaccccgactaccagacccgccgtcgtgaacgcagggaaaccctgcgagccacactcagggccgcccagcagcatgtcaggacacactgatacccgctcatacacacaccatgaaacacgacaagccacctgacagtatcagctgcaagacgcatgacaacatagaaggacatgatgaaatacacatagacacaaccccgcacagcagtttcgcaacaaatcatgatagtctcatggcagtatcgcttgatacacacatagcatcactcccacataggcagttatgctgatatactcctactaggttatccgtccaacatgctgagtgggttcctgtacagcatgaaaggagcatggcatgatatgggccgttctcaactgcaagggtggtgtcggcaagacgaccagtgccctcctgctggcggcagccgccgccaagcagggccacaccaccctggtggccgacgctgacccccagggcaccgcatcccagtggtcagccctggcaaccaaaaacgacgaacccctgcccttcccggtgcaagcggtcaacatcgccaccatggaggcactgcccaccaccaccgacgcccatgatctcatcctcgttgacacacccccctcggcaggcgatctgatgttccaggcatgccgcatcgccgacctcatcatcatccccaccgccacctccggacccgacatctcccgaacatgggtcaccatggacgccacacaaggcacaccacgcgcgatcctcctcacccaaaccgaacacaaccgtgtcgtctaccgccaagctcgcactgccctcgccgccgacgacaccgtcgttctcctggaccacgacatcccccgccgtgaatccatccgcacagcatggggcaccaaccccccagacgacgtcatcacctactacctgcccgtcctcaacgaactcatggaggccctgtcatgaccaccaagaaaaccgacccattcgcccgccagaaagcagcagaagaccgcgcccaccaactccaagacgaagcccaacgccacgcccaccccaaacgcgtcatcggccccaccgcacgattccagttcgtcctgccagccgacgtgctcaccggcctcaaacacctcgccctcacccgcggcaccaccgcccgccaactcaccctcgacgccctcgacaccgcctacggcctcgacaccctcgccaacagcgggaagaaaacccacccatgacccgtgggtccccctgccaccaccccctcgacggcaactgtgtgcgagccacaggcccgcacacaggcggcagcccagtgccgtccccgccaggaaaggaactgaacttttctggagtgctggctccctatcaccccttatggtgctatcagatccagtagcgccagcccgagaggaaacccatgagctacatcgtccgcaccggaaatctagccggcacccccgagctgcgcgaggggtagccgacacggcggaccgtgcccctgacagtaagcggcactactggagacatcaccatgaccgctcagatcctcgccccgtgcaaccagaaggctgccgtcatcgaaggagccctgccatgaaccaacctaccccccacaaggccgacgagtcacagacgagcaacaccacgaggaagtggcggcacaaggtgtcgttctaccaagacccggccgacaccgaccgagtccgcggagcgatcctccacaccatgacaaccgaaggcaaccggaacctgagccagttcgtcaacgatgccgtcatggccaaggtgaccgaactggaagcaaaatacaaccacggcgagccattccccgccgtgggagcccgaggactcccccagggcggcgcagccgccaacagataagagggcggggaccaccaatagcagtcgatttcggatccagatcgggtagacaggacccatgatgaatttcatatcctccctgctctcggccatcctgactctctttgcgatggtagccgtggcgataggagtggtgaacattgtgccgggaatatgcgccatcatcggtgcacggaaatacggcgaccaggaccgtgtgcgggcaggacaacgaaagatccttcttggtgctatcgccttggtggtagcagtaggcattcacccgtgacccacggttaccggaagccccgccgcaatcgataccactgtcagtaccatcaggggcgataggggtcaagctctccttgtcacaatcccttccccggcagcccagtaaccgtcgcttacagccatacatggatatgcgcccattcgtcggcaccgacgccgtgcgggttggcgacgctgacccgtctgctcacaaacgacccttccagcccagcaccacccactacaccgacacgatccacgaagctgaaaccgaacctcccatccccgtccgaaacatcaacgaactcatcaaccccaccaaccatgcatgaacgcacgatcgcctaccggccagccttcctgcgcgacgtgaagcggctcaaaaacaagcactacaacatgaacacacactcaaatgggcggtaaggtcacgaagtcgacgtggctgcctcacggatggcttcggcgagctcttggggtcgactccacatgggccagtggccggttggcagatccatcgcggtgaagttggtcaggtgcgcgacggcgctgaacatcggattgcctgctgcggccagctcgaggacctggacgctgggaatggagcagcagatcaacgtggttagtacatcatggcgagcgctattggacagcgcgacccgtgcccgggccacttgcgcgggttcaggaaccgcccgtgcccggaaccggtcaaggtgctcgttgctgaggccctctaaactggcctgcttgccgagagtatcgaagtcaggaagtggcagctcagctgtttcctcaggtagatctggtgcgaaggcacctccatcgctcatgggaccggagtccacccagacgatccgatggaccaactctgggtgcctgtctacaactaggctcaccggcccgttcgcgccactgtgtcccaccaggaccgcatcgccgcccatctcgtccaggatggctgagatggcgtcagcttggtcgtcgagcgtgcgcgtagtgcgctgggtgtcctccggatcgaggccaggcagcgtcagccccacggctcgactgccagcagtgttcaataactcgactacctcgtcccaagcccaggctccgagccagtaaccaggaacgaggacgataggccgatgctggtcaggtcgcgatgttgaagtcatggagacatagttgcacagtgcgcggacaagggagtggcactatttctggcatgaatttagatctgggtgtccggtgaggcgatcagaacgcctccatgtactgtccgagtgtctacgatgcagcggacacagtcgagcagctggctcacaagtttccaggtgtccttctgcccctatgagggaagtcggctgctctcgcaacctttgagggctgctctggggtcggaaccagttacagatcgttcaagttccgggaactaccgccggtcacgctgattgattcccgggcgatctcgcttctgacgacagtggtcggtaaccgagaggcgtcctactctgaccccgctgctgcggtgagtaaatcacgggcgtcccggatccggccacccgtccaagtgccagccagcttgatcggctaggcatcgtcaaggagcgacgatgaggtgatgatgcgatgtgagcgcaccgcgaagtgaggtataaagaagccttcccgggcgcatgcgtcgcccaggaaggccaggttggcccctggacggctgaatggttgggcggatcaggctgtagcggagacgtgcagtacctcgtaggcgatggcgttggttggggtctggtctgcatcgtggctactgagttcgacgaggatgacggtccaggtggtgatgtcgacggcggtgacgcgggcgatggtggaatcagtggatgctgcaaggaagtcggcggttatgtcttcgatgcagtgggacggagcagtgctggtgggcaggggcacggtcttgacggtcaggcttcgggcagcagagtaatcggcggttccgttaacaagctggtggacggtccagtcctggatcgggtgccggccgaagtcgcgtacgatagccgagtaaccaagttcgccccagcagaactggcgcatcccctctatgtcgcgccagacgtagaagggcgcgtaggagttctggggtgcgcctttgaccttttcttggatgaggtaggccttgaactccagtccatggtagccgtccatgaggtgtccagtctggatgacgcggtcgcggatgatctgcatgtcatagtcggtgggcagggtgatctgatattgcatggcgtacatcagcggttctccttggtttcgtgggagtaggtcgtgggggtgacgggttcctgccaatcgatggttgacaagtcgtcggcggcttgttggtaggtaaggtggatcattggctgtttgagtgcagcgccatgccagtgtctctggccggcgtcgatccagatggattcgcccttggtcaggtgctggggtgcttgtccttcaatatggaccagggcaacgccgcccgtgacgtagaggccctgtcccttggggtgtgtgcctcagcggcaaacgtgacggcgtgggcggcacgcccggcgtcttccgtggcacgatcggccggatccatggcggcgcgcagctgctgttctgcagccaggcgtccaggtcacggcgggcagcatcgacacccagggcagcctcgacggcttcagggctacgacgctggccgggctggttgaccgcagaccactggtgccgggcgtcgtccagatcatggccggcggcgtcgatgagggcggtggtggcttcggcgcagcatcgcctgatccactccgaacgtgacaggccagctgtctcggcggcactgtcaatgcgcgccaggagagatttcatgggcgctcatctgtagcctccagataggcgttgatgtagcgcagagcctgatccgtcatgtcgatggcggctgcctcggcagacgacacaacgggctgtggatgataagaccacccaacatagacggcgaacatcaatttctcgacagctttcatgaggtccccggcggcaaccgcatccgcctcatcatccgaggagaaccacttcaggtctgaacggctgtacatagcccctaggtcctgatgtgggtcgaggtccttg

SEQ ID NO: 234 - DNA, 6142 bp, Propionibacterium acnes
atctgctgacagcataacgggcctgcccttgaagggttggactctgcacccatttcagccgggtacgttgccggctgggcgaaggaagcagacggcgccgcgattgaagctgccgccgagcacgtcgcgaagacctcccacgcgattgccgaggcgttgcagctcaccgcacagtgagccccacggggcgaccggctcaccccggtcgcccctcaccccccgacaggggaaccgttcccgccgcctgaatctccatacccctgatacgtactacgcggggtcgaggagtggactcccccaccctcgtgtagtacactatactacacagtcattgaggatagaggtgacgtcatgagtttttcgatccgtttaaccgaccatgagcgccgcttagctgattcctacgcccgcctgcactcgcagtccctgagtgaggctttcaagcaagccctcttcgaccgcatcgccgacgagttcgatctgcaagtagcccgtgaggcactcaccgactacgcccgcgacaactaccagtctcgccccatcagcgagctatgggacgagtgtgacctatgagctggcagatcgaaaccacgagccggttcgataaagaattcaaaaagctagaccgctacacccaaaaactcattcacggctggatcacgaaaaacatcgacaacaccgacgatccccgccgccacggcaagcccctcaccggtgatctttccggactgtggcgctaccgcatcggcgactaccgcctcatctgcacactcaacgataaccgcctcaccatcctcgccctgtccatcggtcaccgccgcgacatctaccgataagccgttgcaagactgcggcgtcgacaccgccgggaccctggcccaggccttgggcctggaggaggacgagagcgaggagcacgccgcctgagcggtcgccggcacttcccataacagcaccggtcccggcggcccggccccgcgtctggtgctcggaccgatgccggcgcctggcctccgacgcccgccggggccagcggctgggctacctcgacgtcgacgtacaacgggccgaacgaaccgtgcgctgatttaccaccgcttccgcacagagaacatgcctctgactaggagaaatgacgttttccacagggcctctattactaatatccctattatctctatccacgcgcgcgagcctcagcgttcaagcttcaggtcttgctcgtctccctcgcgcctcgctgcgctcgttgctactgccgccccacccggcaagccgggtgggttgccatcggaataccgtggaccatcccggcgcatacacccagacggtccaagatccaatccacgctcacccgcgacgccgctaacgatcctcatacaccgtagatgccgttctgagagccttccagacccgcacgtgggtttattgcaccgagacccaaatcccctcagaagcgatcctgaaaccgtctacgccccatttccgacggacgctggacaggctgggcggcttgtctcccgccgcagacatggccctggcatatgcggttgccgactggtgggatcagggattggatcacacggcagacggctggtccaaggcgggtgtgcaggtgcggtgagcggcagacgtgaccggtggggtgcactgtcatggccgggcatctgccgagccaccatgcgggccctggaccaggaggcagcccgctgcgaggactgggggaagacggcggcacggatgggccgtcgggatgcggcggccggattcaccgagactgcggtgcagcatcgtggacagatgcaccacctcatgtcggcacaaaaagtgtgggtgtcgaccgacatggtgtcggctacactggacgccgcaggagacgtgccgagtttcgaggccgtcgacgtccctgccgccgggctcatgggtttggccagccccctgccgccggttaccctgcagcatccgctgtatctgcgcagcgacgagggtgtgacaaccttcactgatccggttctcgtcgacgcgctgggatggtggatggattctgggcgtgtgcacgtggtgatgtgcacacgcacaccccggctgcccaacccggtttatgcggtggcctccccactgacggtggtggagaaaatcacggtgcccaccggcatcgagttcgagaccatggagtccaggatcctgacccccggcggcgtgacaggcgtctcacggcagggcacacgcatgatgatccggttggcgtcatggctgggtgccgcgtgggtgctcatggcgactccgacggtgtcggagccgcaccctatggatggccggtggggaggcccagcaacggggcagacccggccgcgtgatcgggtgaccgtggtcgacatgcggcccatgaggcaggtgcacaccaccaccgaccccaccggcaggcggttgacgacccggcatgtcgtgcgaggacactggacacaccaaccctacggcccggcccgcagtctccgacgcctgcagtgggtcgccccattcatccgcggccccgaaggggctccgttcgtcggcaccgacaccgtcaccgtatggcgccgctagatacgcgggcgcggggggttgacgaacgatgcccccctctttgtgttgtgatcagtcgtgatcggcgggttttaggtcggggtaggtgtcgagaatggccttgaggacgaggtcttggattgtggtgtcattctgggctgccttgaccttcagtccaacgccgatgtcccgggggattctggtctgcaacttgaacaggtctgcctccttggttttgaacagtttggctgcagggttggcaacgggctgttcttggcgctggcgtccaaggttgcttttctttcgggcggtcatgacatcatctccaacagttcgtcggcaacatcggcgaagaaggcgatagtttccggctcaggggtacagccgtaggcgcgcttgatgacttgacgcttggggatgacgtgatcgaccaactgcgtctgggagtcgttggctagaaggtcgcgaccttccttgaacagggaggtattcggttcagctttggaaagcagcaccacgcgcggggttcctgcggcggcgtcgtgcgtctcccaggtgcgcgccatgtcgagcccggacgtgtcggtggggatgataaccagatcggcggcgcgaatggcggcggtgatgatgtcaccgttgcccggcggggtgtcaatgatgacaacttcttcgggtccggcgacgaggtgctggagcgtcgccttgttggccggttccacggggaaccccaaggggtcggcgttactcagtgtgcactcggcccaggatgatgctgacccttgagggtcggcatctttgacgcggaccatacggcccgtctcatggagagctgcagccagcaggatcgctgccgtggtcttaccgacgccacccttggcgttgataatgctccagatcatggtgacacctttcagtgaggatgcatatcagtttacctgcaaggagtaaagacggcaagcagttatgccgtttctgcggcaagccgtcttgcatccttggatgtatagatagttgtctacttatggttgtggatcgtggtgtctcgtaccaggatttagtgtgctcgctgatatgcacgactttcgggcggcctgatctggcggtggtgccactaacccaggagtctgatccgcaaggtgtcctcgactttgaggaaggggtctctgctttcgtgttgacctaaagtcaacggccctgggcgatcactgaatcctaataactttgtatccttccctgattgcatcttagcatccttgaattcaaacagggatggagccatgctgttttgacgacatggatgcactggggtttggttgttgccgatgcggagcgtcaggcggcccgggacgccgccaccgccgacacgctgcgggagatcgtgggactgctgggccggggcggcgaggtcccgcccgccaagacggggcgtaagacgaccggcaggccggccccggcccgcaagtcgtcggccacgcagtaaaggcagggatccgtccctacgcagagagcggaggcagatcctgggggatccgactcttcggttccgtgatcttcccggagatcttcccggatcccccagggctcatcctgatacggggtccgccgacggaccccgtatcagtgggggcgctgccaccagtgatggcgggcgggtcggtcggcgtctaggccccgcccgatggtcgcctggtctacctcgcaggcccgtgctgttgccgaggccgagaacgtctgcccacttgttgccgattcagtcccctctccgtctgccatgtcgccaacctttcctatctggcgtgctcatggacatgcccgggcacgccctcgctgctcagaggcctgctcgttccacctctggccgcgaaccgtatttctgctgaccactcctcgtgcgtgaatatttgccagccttggccattcatatttggactactctgcaccagatatcggactgggaaacctcttgcacatctctaattgtcatctattcgttgggcgcgcgctgttagatcgtgatcataccaatcagaagacaaagcgacgcccttttgagcggcttttcgaacgattctagaccgcgctatatcagcatttctaccgcgcggccagagtgctacactaaattcctctctgcaatccttaagtccattctttacttcctcatccaatttctgcgacagcatttttatggaagcatcgcactctgactcatcatcaaatgcctcaattgcgtgcgttcgccattcacggcgcgtattatcgtagccgtaatgaagtattacccaccgatccacagaatcatcgttaggatctacaactgtcatgaatggcccaactctcgctctggtgtattctcaattgcagttcagtgactttacttgaccagtcccggatttagtagacgtagacggagagtaccccgccgggaacttgactgacatcactgctgtaccgtactgctttcccgggtggcaaccatcgtaagcagcatttgccgtgacgtacctagtgctctttctctgagtgccggtaatcgccttatatggtacaggtgggtgaatcgtagccgttacggctaccgatgacacgtttgcatcacatgaagctgtggcgacataattagttgtcccattgacatgatgagagtcgtggacatactgtcgaggatcgagagtgcaggttattgttgacgccgttgttctggtaccagctgctttcgagctctttgttgcagttacagtctgcggccctgaaggttttactgacgcgactgatgtgttcgcgtgttttgcggcagtgctttgatttggttgtgcttgtgtagcagttgctgatgtcgccagtgatgcccccattaccatagctgtgattatggcgtagtctttacgcttcattgcgcccccaaataagcatgttagtttgctattttgaataggatacgagacatcgccatgacttgtcaagggcagaagtagaaagaatcggggggtatcaagaaagatgtgctttcatcaggacgaaagcggatgggtccgttcgacttggtgacgaatgatccggccttgcgtcgcggagaccaggccggcgagtttgtcgagcagggccgccgtggcctcatcgtcgggcacatcactaaagggacgaacaaccatgacggctagggccagaaacgaccggaactgaatcgcatgtggacccccatctggcaccaggcacacacctaccgaccggaaaccctgcaccctgtcgctcccagttcacctcctaatatgcgcctatagtctgtgctagtagacattattttgtgtgttgtttcccatctggcatgtctggccccggacccgccgcgacacgcggtggtggataacagaccaggacccccggaccatagagaccagggggacgagacagtcccccggtgaggatgtctcgatgtgcagatcaggaacagaatcgccgggcacgacccggcgccggtgccggtgcagtgaacccgtggcccatcgactccacgaacgaacgtctcgccttcctcaactggtgttggcggcaaggctactcagcagccatcgtggaa

SEQ ID NO: 235 - DNA, 5731 bp, Propionibacterium acnes
tgcgctgatttaccaccgcttccgcacagagaacatgcctctgactaggagaaatgacgttttccacagggcctctattactaatatccctattatctctatccacgcgcgcgagcctcagcgttcaagcttcaggtcttgctcgtctccctcgcgcctcgctgcgctcgttgctactgccgccccacccggcaagccgggtgggttgccatcggaataccgtggaccatcccggcgcatacacccagacggtccaagatccaatccacgctcacccgcgacgccgctaacgatcctcatacaccgtagatgccgttctgagagccttccagacccgcacgtgggtttattgcaccgagacccaaatcccctcagaagcgatcctgaaaccgtctacgccccatttccgacggacgctggacaggctgggcggcttgtctcccgccgcagacatggccctggcatatgcggttgccgactggtgggatcagggattggatcacacggcagacggctggtccaaggcgggtgtgcaggtgcggtgagcggcagacgtgaccggtggggtgcactgtcatggccgggcatctgccgagccaccatgcgggccctggaccaggaggcagcccgctgcgaggactgggggaagacggcggcacggatgggccgtcgggatgcggcggccgaattcaccgagactgcggtgcagcatcgtggacagatgcaccacctcatgtcggcacaaaaagtgtgggtgtcgaccgacatggtgtcggctacactggacgccgcaggagacgtgccgagtttcgaggccgtcgacgtccctgccgccgggctcatgggtttggccagccccctgccgccggttaccctgcagcatccgctgtatctgcgcagcgacgagggtgtgacaaccttcactgatccggttctcgtcgacgcgctgggatggtggatggattctgggcgtgtgcacgtggtgatgtgcacacgcacaccccggctgcccaacccggtttatgcggtggcctccccactgacggtggtggagaaaatcacggtgcccaccggcatcgagttcgagaccatggagtccaggatcctgacccccggcggcgtgacaggcgtctcacggcagggcacacgcatgatgatccggttggcgtcatggctgggtgccgcgtgggtgctcatggcgactccgacggtgtcggagccgcaccctatggatggccggtggggaggcccagcaacggggcagacccggccgcgtgatcgggtgaccgtggtcgacatgcggcccatgaggcaggtgcacaccaccaccgaccccaccggcaggcggttgacgacccggcatgtcgtgcgaggacactggacacaccaaccctacggcccggcccgcagtctccgacgcctgcagtgggtcgccccattcatccgcggccccgaaggggctccgttcgtcggcaccgacaccgtcaccgtatggcgccgctagatacgcgggcgcggggggttgacgaacgatgcccccctctttgtgttgtgatcagtcgtgatcggcgggttttaggtcggggtaggtgtcgagaatggccttgaggacgaggtcttggattgtggtgtcattctgggctgccttgaccttcagtccaacgccgatgtcccgggggattctggtctgcaacttgaacaggtctgcctccttggttttgaacagtttggctgcagggttggcaacgggctgttcttggcgctggcgtccaaggttgcttttctttcgggcggtcatgacatcatctccaacagttcgtcggcaacatcggcgaagaaggcgatagtttccggctcaggggtacagccgtaggcgcgcttgatgacttgacgcttggggatgacgtgatcgaccaactgcgtctgggagtcgttggctagaaggtcgcgaccttccttgaacagggaggtattcggttcagctttggaaagcagcaccacgcgcggggttcctgcggcggcgtcgtgcgtctcccaggtgcgcgccatgtcgagcccggacgtgtcggtggggatgataaccagatcggcggcgcgaatggcggcggtgatgatgtcaccgttgcccggcggggtgtcaatgatgacaacttcttcgggtccggcgacgaggtgctggagcgtcgccttgttggccggttccacggggaaccccaaggggtcggcgttactcagtgtgcactcggcccaggatgatgctgacccttgagggtcggcatctttgacgcggaccatacggcccgtctcatggagagctgcagccagcaggatcgctgccgtggtcttaccgacgccacccttggcgttgataatgctccagatcatggtgacacctttcagtgaggatgcatatcagtttacctgcaaggagtaaagacggcaagcagttatgccgtttctgcggcaagccgtcttgcatccttggatgtatagatagttgtctacttatggttgtggatcgtggtgtctcgtaccaggatttagtgtgctcgctgatatgcacgactttcgggcggcctgatctggcggtggtgccactaacccaggagtctgatccgcaaggtgtcctcgactttgaggaaggggtctctgctttcgtgttgacctaaagtcaacggccctgggcgatcactgaatcctaataactttgtatccttccctgattgcatcttagcatccttgaattcaaacagggatggagccatgctgttttgacgacatggatgcactggggtttggttgttgccgatgcggagcgtcaggcggcccgggacgccgccaccgccgacacgctgcgggagatcgtgggactgctgggccggggcggcgaggtcccgcccgccaagacggggcgtaagacgaccggcaggccggccccggcccgcaagtcgtcggccacgcagtaaaggcagggatccgtccctacgcagagagcggaggcagatcctgggggatccgactcttcggttccgtgatcttcccggagatcttcccggatcccccagggctcatcctgatacggggtccgccgacggaccccgtatcagtgggggcgctgccaccagtgatggcgggcgggtcggtcggcgtctaggccccgcccgatggtcgcctggtctacctcgcaggcccgtgctgttgccgaggccgagaacgtctgcccacttgttgccgattcagtcccctctccgtctgccatgtcgccaacctttcctatctggcgtgctcatggacatgcccgggcacgccctcgctgctcagaggcctgctcgttccacctctggccgcgaaccgtatttctgctgaccactcctcgtgcgtgaatatttgccagccttggccattcatatttggactactctgcaccagatatcggactgggaaacctcttgcacatctctaattgtcatctattcgttgggcgcgcgctgttagatcgtgatcataccaatcagaagacaaagcgacgcccttttgagcggcttttcgaacgattctagaccgcgctatatcagcatttctaccgcgcggccagagtgctacactaaattcctctctgcaatccttaagtccattctttacttcctcatccaatttctgcgacagcatttttatggaagcatcgcactctgactcatcatcaaatgcctcaattgcgtgcgttcgccattcacggcgcgtattatcgtagccgtaatgaagtattacccaccgatccacagaatcatcgttaggatctacaactgtcatgaatggcccaactctcgctctggtgtattctcaattgcagttcagtgactttacttgaccagtcccggatttagtagacgtagacggagagtaccccgccgggaacttgactgacatcactgctgtaccgtactgctttcccgggtggcaaccatcgtaagcagcatttgccgtgacgtacctagtgctctttctctgagtgccggtaatcgccttatatggtacaggtgggtgaatcgtagccgttacggctaccgatgacacgtttgcatcacatgaagctgtggcgacataattagttgtcccattgacatgatgagagtcgtggacatactgtcgaggatcgagagtgcaggttattgttgacgccgttgttctggtaccagctgctttcgagctctttgttgcagttacagtctgcggccctgaaggttttactgacgcgactgatgtgttcgcgtgttttgcggcagtgctttgatttggttgtgcttgtgtagcagttgctgatgtcgccagtgatgcccccattaccatagctgtgattatggcgtagtctttacgcttcattgcgcccccaaataagcatgttagtttgctattttgaataggatacgagacatcgccatgacttgtcaagggcagaagtagaaagaatcggggggtatcaagaaagatgtgctttcatcaggacgaaagcggatgggtccgttcgacttggtaacgaatgatccggccttgcgtcgcggagaccaggccggcgagtttgtcgagcagggccgccgtggcctcatcgtcgggcacatcactaaagggacgaacaaccatgacggctagggccagaaacgaccggaactgaatcgcatgtggacccccatctggcaccaggcacacacctaccgaccggaaaccctgcaccctgtcgctcccagttcacctcctaatatgcgcctatagtctgtgctagtagacattattttgtgtgttgtttcccatctggcatgtctggccccggacccgccgcgacacgcggtggtggataacagaccaggacccccggaccatagagaccagggggacgagacagtcccccggtgaggatgtctcgatgtgcagatcaggaacagaatcgccgggcacgacccggcgccggtgccggtgcagtgaacccgtggcccatcgactccacgaacgaacgtctcgccttcctcaactggtgttggcggcaaggctactcagcagccatcgtggaaacgatggacgccgcgggagcctacgaccacctcgacgacgaccagaccagcaaccagcacgactaacgccgctcccagcacgggggaaggcggcgcaccaggtgcgccgccttcccccgtgctggtgtctcgtcggcttactggtgggggtcgtaggggaacccgtaggtgtgttccagggccttgcggagaaggtcgttcatagttgtgtgttcggcgacggccttcatcttcagcgccgtgtgggtggcggtgggtagcttgacgttgaacgcggtgatcggggtcttggccgactggaaggtttcagagacactggctccctggctggccgccatttggtcggcgtaacggctggctttgtcggcggcggtgggtttgcggttcttactcacttcagcatctccttgattcggtcggcaacctgggcgaactctcctagatctgttggccgggttccgatggcttgccgataggcgacccgtcgatgaacctccgcatcgagaacgtctaggccctcaacggcggcggccccctcgtgggcatcacggtattgcctggtccaatcggctttgttgaagagcagggcccggcgtgtgccgtgggccacctggtaggtcattagcgctcggtccatgtccaggtcccccgactcggtcgggatgatg

SEQ ID NO: 236 - DNA, 5381 bp, Propionibacterium acnes
cacccacgacaacccccatgaacgccgcctagcccgtgacgctgaacgcgcccggctcatcgacgaccaactccgccgccgcgcagaaaccgccacctgcgcagcccgcctcgcagccgagcacgccgaccccgactaccagacccgccgtcgtgaacgcagggaaaccctgcgagccacactcagggccgcccagcagcatgtcaggacacactgatacccgctcatacgcacaccatgaaacacgacaagccacctgacagtatcagctgcaagacgcatgacaacatagaaggacatgatgaaatacacatagacacaaccccgcacagcagtttcgcaacaaatcatgatagtctcatggcagtatcgcttgatacacacatagcatcactcccacataggcagttatgctgatatactcctactaggttatccgtccaacatgctgagtgggttcctgtacagcatgaaaggagcatggcatgatatgggccgttctcaactgcaagggtggtgtcggcaagacgaccagtgccctcctgctggcggcagccgccgccaagcagggccacaccaccctggtggccgacgctgacccccagggcaccgcatcccagtggtcagccctggcaaccaaaaacgacgaacccctgcccttcccggtgcaagcggtcaacatcgccaccatggaggcactgcccaccaccaccgacgcccatgatctcatcctcgttgacacacccccctcggcaggcgatctgatgttccaggcatgccgcatcgccgacctcatcatcatccccaccgccacctccggacccgacatctcccgaacatgggtcaccatggacgccacacaaggcacaccacgcgcgatcctcctcacccaaaccgaacacaaccgtgtcgtctaccgccaagctcgcactgccctcgccgccgacgacaccgtcgttctcctggaccacgacatcccccgccgtgaatccatccgcacagcatggggcaccaaccccccagacgacgtcatcacctactacctgcccgtcctcaacgaactcatggaggccctgtcatgaccaccaagaaaaccgacccattcgcccgccagaaagcagcagaagaccgcgcccaccaactccaagacgaagcccaacgccacgcccaccccaaacgcgtcatcggccccaccgcacgattccagttcgtcctgccagccgacgtgctcaccggcctcaaacacctcgccctcacccgcggcaccaccgcccgccaactcaccctcgacgccctcgacaccgcctacggcctcgacaccctcgccaacagcgggaagaaaacccacccatgacccgtgggtccccctgtcaccaccccctcgacggcaactgtgtgcgagccacaggcccgcacacaggcggcagcccagtgccgtccccgccaggaaaggaactgaacttttctggagtgctggctccctatcaccccttatggtgctatcagatccagtagcgccagcccgagaggaaacccatgagctacatcgtccgcaccggaaatctagccggcacccccgagctgcgcgaggggtagccgacacggcggaccgtgcccctgacagtaagcggcactactggagacatcaccatgaccgctcagatcctcgccccgtgcaaccagaaggctgccgtcatcgaaggagccctgccatgaaccaacctaccccccacaaggccgacgagtcacagacgagcaacaccacgaggaagtggcggcacaaggtgtcgttctaccaagacccggccgacaccgaccgagtccgcggagcgatcctccacaccatgacaaccgaaggcaaccggaacctgagccagttcgtcaacgatgccgtcatggccaaggtgaccgaactggaagcaaaatacaaccacggcgagccattccccgccgtgggagcccgaggactcccccagggcggcgcagccgccaacagataagagggcggggaccaccaatagcagtcgatttcggatccagatcgggtagacaggacccatgatgaatttcatatcctccctgctctcggccatcctgaccctctttgcgatggtagccgtggcgataggagtggtgaacattgtgccgggaatatgcgccatcatcggtgcacggaaatacggcgaccaggaccgtgtgcgggcaggacaacgaaagatccttcttggtgctatcgccttggtggtagcagtaggcattcacccgtgacccacggttaccggaagccccgccgcaatcgataccactgtcagtaccatcaggggcgataggggtcaagctctccttgtcacaatcccttccccggcagcccagtaaccgtcgcttacagccatacatggatatgcgcccattcgtcggcaccgacgccgtgcgggttggcgacgctgacccgtctgctcacaaacgacccttccagcccagcaccacccactacaccgacacgatccacgaagctgaaaccgaacctcccatccccgtccgaaacatcaacgaactcatcaaccccaccaaccatgcatgaacgcacgatcgcctaccggccagccttcctgcgcgacgtgaagcggctcaaaaacaagcactacaacatgaacacacactcaaatgggcggtaaggtcacgaagtcgacgtggctgcctcacggatggcttcggcgagctcttggggtcgactccacatgggccagtggccggttggcagatccatcgcggtgaagttggtcaggtgcgcgacggcgctgaacatcggattgcctgctgcggccagctcgaggacctggacgctgggaatggagcagcagatcaacgtggttagtacatcatggcgagcgctattggacagcgcgacccgtgcccgggccacttgcgcgggttcaggaaccgcccgtgcccggaaccggtcaaggtgctcgttgctgaggccctctaaactggcctgcttgccgagagtatcgaagtcaggaagtggcagctcagctgtttcctcaggtagatctggtgcgaaggcacctccatcgctcatgggaccggagtccacccagacgatccgatggaccaactctgggtgcctgtctacaactaggctcaccggcccgttcgcgccactgtgtcccaccaggaccgcatcgccgcccatctcgtccaggatggctgagatggcgtcagcttggtcgtcgagcgtgcgcgtagtgcgctgggtgtcctccggatcgaggccaggcagcgtcagccccacggctcgactgccagcagtgttcaataactcgactacctcgtcccaagcccaggctccgagccagtaaccaggaacgaggacgataggccgatgctggtcaggtcgcgatgttgaagtcatggagacatagttgcacagtgcgcggacaagggagtggcactatttctggcatgaatttagatctgggtgtccggtgaggcgatcagaacgcctccatgtactgtccgagtgtctacgatgcagcggacacagtcgagcagctggctcacaagtttccaggtgtccttctgcccctatgagggaagtcggctgctctcgcaacctttgagggctgctctggggtcggaaccagttacagatcgttcaagttccgggaactaccgccggtcacgctgattgattcccgggcgatctcgcttctgacgacagtggtcggtaaccgagaggcgtcctactctgaccccgctgctgcggtgagtaaatcacgggcgtcccggatccggccacccgtccaagtgccagccagcttgatcggctaggcatcgtcaaggagcgacgatgaggtgatgatgcgatgtgagcgcaccgcgaagtgaggtataaagaagccttcccgggcgcatgcgtcgcccaggaaggccaggttggcccctggacggctgaatggttgggcggatcaggctgtagcggagacgtgcagtacctcgtaggcgatggcgttggttgggctctggtctgcatcgtggctactgagttcgacgaggatgacggtccaggtggtgatgtcgacggcggtgacgcgggcgatggtggaatcagtggatgctgcaaggaagtcggcggttatgtcttcgatgcagtgggacggagcagtgctggtgggcaggggcacggtcttgacggtcaggcttcgggcagcagagtaatcggcggttccgttaacaagctggtggacggtccagtcctggatcgggtgccggccgaagtcgcgtacgatagccgagtaaccaagttcgccccagcagaactggcgcatcccctctatgtcgcgccagacgtagaagggcgcgtaggagttctggggtgcgcctttgaccttttcttggatgaggtaggccttgaactccagtccatggtagccgtccatgaggtgtccagtctggatgacgcggtcgcggatgatctgcatgtcatagtcggtgggcagggtgatctgatattgcatggcgtacatcagcggttctccttggtttcgtgggagtaggtcgtggggatgacgggttcctgccaatcgatggttgacaagtcgtcggcggcttgttggtaggtaaggtggatcattggctgtttgagtgcagcgccatgccagtgtctctggccggcgtcgatccagatggattcgcccttggtcaggtgctggggtgcttgtccttcaatatggaccagggcaacgccgcccgtgacgtagaggccctgtcccttggggtgtgtgcctcagcggcaaacgtgacggcgtgggcggcacgcccggcgtcttccgtggcacgatcggccggatccatggcggcgcgcagctgctgttctgcagccaggcgtccaggtcacggcgggcagcatcgacacccagggcagcctcgacggcttcagggctacgacgctggccgggctggttgaccgcagaccactggtgccgggcgtcgtccagatcatggccggcggcgtcgatgagggcggtggtggcttcggcgcagcatcgcctgatccactccgaacgtgacaggccagctgtctcggcggcactgtcaatgcgcgccaggagagatttcatgggcgctcatctgtagcctccagataggcgttgatgtagcgcagagcctgatccgtcatgtcgatggcggctgcctcggcagacgacacaacgggctgtggatgataagaccacccaacatagacggcgaacatcaatttctcgacagctttcatgaggtccccggcggcaaccgcatccgcctcatcatccgaggagaaccacttcaggtctgaacggctgtacatagcccctaggtcctgatgtgggtcgaggtcc

SEQ ID NO: 237 - DNA, 5561 bp, Propionibacterium acnes
gggatgaggatgacggccgcgccgacacttcggagcgaggtcatgtgacgatccttcggtagctcgacgggttgccgtagatcttttccacgttgatgccgctgtgggggttgtcggcgctaaccatttggcctccaccgatgtagacggccacgtggtgggcagggtttccccagaggatgaggtcgccgactttgagctggtcacgggccaccgcggtgccgacgtgctgttgttcggcggcggtgcggggaaggctaatgccgatacgccggtacagcgccgaggtcaggcctgagcagtcgtagccgccatcggctttgccgttgccaccccacacgtaggcgtaggagttgttgtcggcgatcgatttggcccatgccacggcttcggccaggttcttcgacacaccggtctcgttagcggccccggtggcacagttgtttgacaggtgccctgtagtagtggatcccactatttgtttggccatggtttcccatttggcgtaggcatcgggcagggctgagccttgcactgcctgagctgcctgcgtcagcggcatcttctgccagtcagcgatgtcgactaaaccgggaatgtggaatccagggccgccggccgatccggggccagcgtaggtgatggtgtggcctttcaagaacgcctcggtggcgtaggcatcattgttgacctgatccagagtcccgtaccagcccggcaggatgcgctgctgaaaggggccggcgtcaccgtcaccgttagccttcgctgaggtagggtcggccccaagatctgattcttgtttggcggtcatgatagcgatgaccgctgcctgggtaggcagtttgtcacgctggaccacagtgacgatggtggtcacgagctgcttctgcctggccgtgaggcctccggcacccacagtgcctccggtgacggtacccacgcaagcatccccgccgacactgccaccgccgccgccagagttgtcgtcgagggccccagagcctactgacagcagcggcacaatgatcacggtcgcgggcaagaccgccaggcccgccagcatcagcactgctgcactcaccacggcgatcacgtgagatgctttcaacgctgcccacctctcgctggtttgagggggcgacgcctgctggtacgcacaggcttggttgatccagtccgccgttgattggcaggcctgggtttgatcggcttgctgggacccggtttgggctccggagtcttaggctccggcttcacatgcctaggcacttcggctgcggtgggaggagtcagcacgtggcgtactggcttggtgaccttctgggcacccgaaacaaccggcttagacaccaccttggcacctttgaccaccggtgcggctgccttcgcgccggccttcttgactgcacgatgcgctttgatagccccggcctcggcccggccaaccctactagcagtagcatcgaaggctctgtggcccgtcgttgccctcaccggtgcatccttgccctggcgggtctgcttagcgatcgccgacatgccgcctcgcaatgccgaaacacggttgtgggcgtgggcgatcgccgacataccggccgtcgtaattttcgactggccctgcggggcccctgccccagcacgaatctgccggtaagccgccgacgtgcgacgagcacccgccgccattcgcgccaccttcgcagccctagtcactcccgtcgacacgccacccgtggctaccgcagcagcacccgagaccacagtcgaggccatccgccttcgacccgatccagtgagcttgcgaccaccactgcgcaccatccggcgagcaccccgcccagcccactggccaatcgccgacgccccttcagagcgcttgctgcgcatccaatcgttgatcttgtccctcagccccttctcgcccttgtgacgacgccacatggacatcaagaacccgataatccccacgagctcgagcatgttgacaaccatgaccttgatggcgacatcaccgtcagaggcgaaaaccgacttgatgatgagcatgaccacacccaacatcaccatcgacccgacaatgccgatcatcgagtacaagatcgaacacagatcccggatgagcggatctgtgcggccagggatagcccgcaacacgttgagcatcgacatgaacgccgaccacaccaacttgcacacgtagaaccagcacatgcccgcgaacaccagcaggaccacagccaaacccgccaccgtcgacgagtaaaagaagaaccccaccaaccacgaaccatccgcaatatcgccggcgtaatccgacaacccctcatcacagtcaccaaggtcgtcgcgagcatccgagacgtcatcgtaagggccacccttgagcacctcgatgtacttgtcgtggcacttcgcatcaataatccggccatagttgagctgctgatgaaccggcgccacgaacgagtccacaatgatcgccgacagcttcggatccttcgagtctcccgtcgaggtcatgtcatcaggaatctcgacctcaccagcggtcgccgtcgcaggatcaaccgaactggtaatcatccgagacagcgccacgccgaactgctgggtgcgagccagcggagtagccaacgtcgtcgtatcgcctgcgaacttcgccactggggccgccaagaaacccaacgccagcgccgcagcaatcgccgcacgcgcacccgtagcccacgcccctgccgtacgtcccctcatcatcttgacgaccacgcccacaccggcgcacgtcgtcagcaacgtcaacaccgttccaccccagctgtccgctcccagcggggccaaaaccttgtcgtggatgtcgttctgtaaccccaccagcggtccggtaatccacccgacccagctcatcgccacggtccagtccaacaaccggcacagcaacgcaatgaccatcaggtacgtgttccaacacatgccaataatggaggcccacatactcttcagcggggccgtaacgccaccatcgtccatcgacatctggtactgaaacaagtgaataccgttggagtcagtcacattgaaaccgtcacccatccagcccagccccgggcccgatgccatggcaggcacactgctcagcgccaccaccaaaaccagcgtggtgacgatgatacgaaatcgccgctccccggccccggggcggcgtggatgacggctcacgctgtctcctggtcgtgctcgggcgggttggagctggcggcttcgcggtggggagcgtaggcaggtctcagtagtcgaatttcaccgacgttgccgtgttggtcggcgtacaggccacaaccggggcctccggggttgagggcaatcttgaccaggtcagcgaactcttcaggggacgtcttgggatctacgcccaggaactcgacacctttctgggcgaggttgatgttgtcgcacagcaacacgatgcgatgctgaatgaggttgcggacggtctcgttggggtaatcggcctcggggtcgtgggagccagtaatgagccaggcgttggctcggcgggattcgcgcacgtactcatcgatggcgtgggaggcttccggcgaggacgacatgtgatgaaactcgtcaacaatgaaagcggcgtcgcgggcccggtcgctgaagcacaccaggcgagccagacgggcaataagcgcgtagagggctcgaccaaacaccttgtgcgggggcagctgccgaaacaaatgttctgacagcatctcctcggcgttaggaagagcgatgccacaagtgccaatgatgaggatgtcggcactcaggtcggcgggaggaaggtccgggtcaaagatggccgaagctagggaggccgagttctcgatgtcagcgaacacggcaatcctgtcagcgatcgcggtggcctcgggaaggtcgcactcctcggccaggtggcgggccaaacgcccacacgaggtgatctggtggtcacgcatgtaggccggtttgaggaccttggccagcgtggtcccggccacaccgatggtctccaagttaagcaaggtcagcaagaacgactgggcgacctgcccggccatctccgggggaaggatgcgcagcgggtccagcgacagcttggggtgggccgtgtcgacgatctggcgtctaaccccgtcgatagagttgacaaaggttacccactcccgctcatcggagttgtcggtggcaataatgcgcccgccccgggccgcgatggctgcgcacagccgcttctcggccatcgtcttgcccgcgcccatcttgccgatgaacgccaccgtgttgcctttctgatcctgagtgtcggcatgcaaatcgaggtaggccagcgactgcaacggggagcctgtgaccacagccaacgggatgccggtggtacggcccaaccggtactcaaccaccgggatagatgcggcgaacgcggaggcgtgagtcagctgacggtaggcgttaagtgaggaggagaaccggccaccgggccgggcagcccacagcaagtcctcctgacggcccacgggacgcacccacgtgaagtcaccgaacaccggatcattgacgaacgctcctgccagctcctcggtggtctcaaagtcaggagacgagacagtgacggtgataagagcctggatctcgacctcacgctcatcggcggccagctcggcgttgtagtcgacgagcacctgagcggaatgctcgatagacatgagggtcgaagcctgggtcatctcaccgccctcaacattgtcgagctgatcgaccgtttgacggatagcccgctgatttttctgcatcgcagcgtgacgggtccgggccactccccggatcgccacgtcgaccggcacgccagtgtcgtcgatacggcccaggaactcgtaggcaggccacgtcatcgtgcggggcaccttacccagcacgatatgggactggtagacggtctcgccggtgtcggcaccgattttgaggacgcgacgattccacgcctgagccgtccgggacatgtgggagactcgcttgtcatcctcgctggccagcaggtcggaggtcgcggcctcatcgatgaccaactcccccagcgcggcacgtccaacctcatccatgagggcgattccctcgccaggggcatcatcacgcaaccgggtcgggtggcctgacaggtgctgccgaagccagatctgttcatcaacggtgaccgggcggggttggaacgctgccggcagtttcgcaccgaattccttagcctgacggagggcccactcccgtgcgacacggccaggagcggtggtcatgagtccggcggcttcggtgattttgttgagggcggcggtccaggcggtgtgggtgcgtattttctggtcttggttgagtttgatcgataggaaccacacgcgccggcctagggattcggtttcaggctggtcgagggtggcgtcgatttcgtcggcccacacggggtgttcgctcaggtcgaggccggcggccatggcgtcgacgatttctgtggggtcggtccaggtgagggctccgttgag

SEQ ID NO: 238 - DNA, 4899 bp, Propionibacterium acnes
gataccgcaaggctgtgtgggatcagctgttcgggatggggcggttgcagccgctgttcgaaatcagcgacgccgaaaacatcatcgtggtgggtaaccatgaggtggttgtcgaccacaacgatggttcccggtcaacgctgccgccggtggccgactcggatgccgagctggaatcccagatcgcccggatggcgaggaatgcgaccccgcggcgagccttcgacgccgatcacaccgatgtgacgatcatgcaccaacagaagttccgtatccacgcgatctcttcggaggtgtcgttgcaaccgtcggtggtcatccgccaacatttgctcacccaaatcagtctgggggacctgtcccagcggggaatgatgccggtggaagtggcccggttcctcgatgaggcggtacaagctggcaagtccatcgtggtcgccggcgagcagggggcaggcaagacgacgtttttacgagcgttgatccacgccattccgatgcgggagcggttcgccacgttggagaccgatcaggagttgttcgctcatctgatgcctggccgggaaaacacgctggtgctgttcgcccgtgatggtaacggcgaggtggatccggcgactggcacccagcacggcgctatcgagatcgcccagctgattcctcctagcctgcgccaggcgttaactagggtcattgtcggtgaggtgcgcggcaatgaggcttcggccatgttccaggctatgcagtcggggactggcactatgagcagtatccactccccgcgagcctctgaggtgccgtcccggctagcccaaatgatttcgatgggcccggtctacgatctggatcaggccatgctgcagatcggtcattcgatcgactacatcgtctttgttcgtaagcgtgacctgcctgatgggagccggctgcgatttgttgagcagatccgttcagtctcgcctggtgattcgacaactcccagtcttggcgaggtgtacacggctgactcgtggacaggccagccgcttacgccactcatgcctggttcggccgccgacgagctgtctcacttcgcccgagacctggattactgcgaggcccactgatgaacaccccagcgctgatagcagccctcatcgtgaccggcctgggactgatcatggccatcaacggcctgatcccggccacacccaaacccggcaccacgctgacgctgtcacagcggtgggcccgggccacccaccgcccagccggggcagccgggcgccgacgcgacctgcgctgggcgctggccggtctcgtcggcatcgtgctgttcgtcctcacaggttgggtcgctgccctggccctgggccccatcaccgtgctgctagcacccaccctgctgggggcggccccaccgaccgatattccgctgatggaggcgttggatcggtgggtgcgtcaggtcgctgcggtgctgccacaggggcgagacatcatcacagcggtgcggatctcacggccgcgggccccgaagctgatcgccgggtcggtggatcaactggtgtcccggttggatggccgtatggagccgagggaggcgttccagcggatggccgacgagctggactcggctgaggctgacgcggtgctggcctcactagcgttggcggccactcatccgcggggagcctcgacaacgttgaaggctattgctggcaacatccaacagcggttgaaagtgctgcggcaggtggaggctgagcggtctaagccgcgtaactcggtgcgccagatcacactggtcacgatcgccatgttcggggggctgctcgtgatcggacggtcgtttctggccccgctggcgacccctcccggtcaggtgctggtggccgtggcggtggtcatgtatgtcatcgcactagtgcagatgtatcggatggcgcggccccgtcgacgcacccggatcatggtcaggaggacccgatgaccattactgctttgtccctgctggccggggccatcgtcactgtcggactgctggtcatcgtggcagcgttccgcccagccccaggccctgacctggttgccgctctggaggtggtgtcgggtcgcacctcaagcgtcgccgagaacgtcgaccagacccggatcgggcggataggtcgcagcgtgacccgcacattccatgtgtcggtgtccccggccatgcgggccgcactgcgactccaaggcacgacccccgaagcgttctacggtcgacgcctgatctgcgcactgatcggggcgatcctgccgtggctgctcaacgcggtagccatcgcggtaggggcgaattccccgaacctactcatcccttcggcgctgtgtgtggcgttagctggcgctggatggatgctgccggcagcacggttgaaggctgcggccgggcccaccaacgatgactcgttcgaagcgctgctggtattcatcgatttggtcgtgctggaacggctcgccaacgaaacctccgtcgacgcgctcaccaatgcggcaaacatgtcggactcgccgctattcgtccagatccgtcaagtcctcaaccgtgcctccctggaaaacgtcgacccgtggaacgggctagaccggctagccgaggacatcaaactgcccgaactcaccgatgtggtctccatcgcccgcctccaaaacgaaggcgcctccctcgtcgacagtttccgggcccgagtcgccgagttgcgcgacgcctacctgctgcgcctgcaacaagaatccaccgccatcacccagcggcttggtttgtggacgatcctgcaagccggctcggtcatgctcatcttgctgggggcggccgccctcacactcatcacagccggataaaccgacatcgtgtcgagcccccatatgggccgcgaacctttcataatgatgcctgtaagcaccacaatattgatcacaacctaacaatgaaggagaaatcatgatgaccgatctcgacctggctaaaaaacagatcacctggctggcggcgcacctgcgttcccggatcgttgacgagcgtggcggtggtagctctaccgtggagacactgatttggattggtgtcatcgtggcgctggtgattggtgtgggcgtcggggtgacggcctatatcaggtcgaagatgcctcactgacgacgatgcgtagcaggttcacaactgatcagcgtggcggtggtagcgcgtcggtggggatgctcctgctgatgcctgcgatcatgctgctggcattcggtgggatcgaggtcgggatgtggtgtcacgcccatcagtcgaccatcgcggcagcccaaagcgccgcggaggctcagcgtgtcgtccatccggtcccggggtcggcacaggaggcagcctcgcagatcactagtcatggcggggtgcgtgatacccggatatcggtcagtgatgacggggccactgtcacggtgaccgtctcaggtcgggccccatcgatgctggggctgcatcttccggctgtgtcgtcgacagcgtcgatgcccaaggagcgcctgtcgtgaggcgaagtgagcgcggtggagcaagtctaagcgtcgaggtgctcatgtgggcgccgatcgcgctggtgatcatcgggtttgttgtgggtatcggccggatgtcgatggcccaggacgcggtgaatggcgcggcgggtgctgcggcccgtgcggcgtcgttggagcgtgatggacagtcggctcagtctgcggcgcagcaggcggcgtcggcgaacctgtcgtccggtgggctggcatgtgcgccgaatgtgagcgtggacacgtcagtgtttgcccgtcctgccgggcaggcgggcacggttcacgccacggtcacgtgtgtcacctcgctgggtcttgggttcgggtcccggacggtgcacgcaacggggtctgccccggtagacacctatcgggaaaggagaggctgagatggcccgtgatgagcgtggtggcggctcggtgtcggtgtggatgctgctcatggtgccggtgattctggtcatggccggcctggtttttgacgggtcccgtcagatatcggcaacccaggcggcccaggacgcggcggttgcggcatcccgcgccggaactgatgcggcagcgacaccgcagcttgctggccacgacggggcggccgtagcagtccaagcggcccgccaggcactatctgctgccggggtggacgggtcggtgcaggaggacgggtcgaccatcacggtgaccacgtctcaaagtcggccgacagtgttcctgtcagcgatcggaatcagccaggtaagggggcatgggcaggcccatgctcagcttgtgggaccgggagaacgcccatgacagtgatacgtcgtatcggtgccctggtggcactgctggtggtgatagccggcttaccggccgggctcgtggccgcaggcgccccgctagtaccggcgggcctgtcatgggcccatgtgcggcatctgttggttaccccagacatgaccgggtcggtgctggtgtggctggtcagcctcatcggctggatcgggtgggcatggttcgccctggccgtcgcagccgaagcggtgacgatgctctcagggcagcggctgcactggcacatgcccggccctcgcctagtgcgccgagtggcagccggtcttctcattgccgcgttcgcggccgcaccggcagccacaagcacggctcacgccgccgaggccacccatgtggcggtcgccgcccaggctggaccggcacacgcggcccccgcccaggacagccccgccaccacctctcaggccccggacgcctccaccactccgaaaatctggaagacctacacggtgcgggccaacgactacctgtggaagatcgccgagcactactacggtgacggcg

SEQ ID NO: 239 - DNA, 5203 bp, Propionibacterium acnes
gcgataccgcaaggctgtgtgggatcagctgttcgggatggggcggttgcagccgctgttcgaaatcagcgacgccgaaaacatcatcgtggtgggtaaccatgaggtggttgtcgaccacaacgatggttcccggtcaacgctgccgccggtggccgactcggatgccgagctggaatcccagatcgcccggatggcgaggaatgcgaccccgcggcgagccttcgacgccgatcacaccgatgtgacgatcatgcaccaacagaagttccgtatccacgcgatctcttcggaggtgtcgttgcaaccgtcggtggtcatccgccaacatttgctcacccaaatcagtctgggggatctgtcccagcgcggaatgatgccggtggaggtggcccggttcctcgatgaggcggtgcaagctggcaagtccattgtggtcgccggtgagcagggtgcaggcaagacgacgtttttacgagcgttgatccacgccattccgatgcgggagcggttcgccacgttggagaccgaccaggagttgttcgctcatctgatgcctggccgacaagacacgctggtgctgttcgcccgtgatggtaacggcgaggtggatccggcgactggcacccagcacggcgctatcgagatcgcccagctgattcctcctagcctgcgccaggcgttaactagggtcattgtcggtgaggtgcgcggcaatgaggcctcggccatgttccaggccatgcagtcgggtacaggcaccatgagcagtatccactccccgcgagcctctgaggtgccgtcccggctagcccaaatgatttcgatgggcccggtctacgatctggatcaggccatgctgcagatcggtcattcgatcgactacatcgtctttgttcgtaagcgtgacctgcctgatgggagccggctgcgatttgttgagcagatccgttcagtctcgcctggtgattcgacaactcccagtcttggcgaggtgtacacggctgactcgtggacaggccagccgttgaccccgctcatgcctggttcggccgccgacgagctgtctcacttcgcccgagacctggattactgcgaggcccactcatgaacactcccgcactaaccagcgccctcatcatggccgggctagggctgatcctggccatcgacgggctggtcccggcgccgcctcgacctggggccccgctgagcccggcccaaaggtgggccaggctcacccaccgtcccacaggagcggccgggcgccgccgggatttgcgttgggggttggctgttctcgtcggcgtcgtgctgtttgtgctcaccgggtgggtggctgcgctggcgttgggccccatcattgtgttgttggcccccaccctgctgggggcggccccaccgaccgatattccgctgatggaggcgttggatcggtgggtgcgtcaggtcgctgcggtgctgccacaggggcgagacatcatcacagcggtgcggatctcacggccgcgggccccgaagctgatcgccgggtcggtggatcaactggtgtcccggttggatggccgtatggagccgagggaggcgttccagcggatggccgacgagctggactcggctgaggctgacgcggtgctggcctcactagcgttggcggccactcacccgcggggagcctcgacaacgttgaaagctattgctggcaacatccaacagcggttgaaagtgctgcggcaggtggaggctgagcggtctaagccgcgtaactcggtgcgccagatcacactggtcacgatcgccatgttcggggggctgctcgtgatcggacggtcgtttctggccccgctggcgacccctcccggtcaggtgctggtgaccgtggcggtggtcatgtatgtcatcgcactagtgcagatgtatcggatggcgcggccccgtcgacgcacccggatcatggttaggaggagtcgatgacgacgactgctttgtccctgctggccggggccatcgtcactgtcggactgctggtcatcgtggcagcgttccgcccagccccaggccctgacctggttgccgctctggaggtggtgtcgggtcgcacctcaagcgtcgccgagaacgtcgaccagacccggatcgggcggataggtcgcagcgtgacccgcacattccatgtgtcggtgtccccggccatgcgggccgcactgcgactccaaggcacgacccccgaagcgttctacggtcgacgcctgatctgcgcactgatcggggcgatcctgccgtggctgctcaacgcggtagccatcgcggtaggggcgaattccccgaacctactcatcccttcggcgctgtgtgtggcgttagctggcgctggatggatgctgccggcagcacggttgaaggctgcggccgggcccaccaacgatgactcgttcgaagcgctgctggtattcatcgatttggtcgtgctggaacggctcgccaacgaaacctccgtcgacgcgctcaccaatgcggcaaacatgtcggactcgccgctattcgtccagatccgtcaagtcctcaaccgtgcctccctggaaaacgtcgacccgtggaacgggctagaccggctagccgaggacatcaaactgcccgaactcaccgatgtggtctccatcgcccgcctccaaaacgaaggcgcctccctcgtcgacagtttccgggcccgagtcgccgagttgcgcgacgcctacctgctgcgcctgcaacaagaatccaccgccatcacccagcggcttggtttgtggacgatcctgcaagccggctcggtcatgctcatcttgctgggggcggccgccctcacactcatcacagccggataaaccgacatcgtgtcgagcccccatatgggccgcgaacctttcataaggatgcctgtaagcaccacaatattgatcacaacctaacaatgaaggagaaatcatgatgaccgatctcgacctggctaaaaaacagatcacctggctggcggcgtacctgcgttcccggatcgttgacgagcgtggcggtggtagctctaccgtggagacactgatttggattggtgtcatcgtggcgctggtgattggtgtgggcgtcggggtgacggcctatatcaggtcgaagatgcctcactgacgacgatgcgtagcaggttcacaactgatcagcgtggcggtggtagcgcgtcggtggggatgctcctgctgatgcctgcgatcatgctgctggcattcggtgggatcgaggtcgggatgtggtgtcacgcccatcagtcgaccatcgcggcagcccaaagcgccgcggaggctcagcgtgtcgtccatccggtcccggggtcggcacaggaggcagcctcgcagatcactagtcatggcggggtgcgtgatgcgcggatatcggtcagtgatgacggggccactgtcacggtgaccgtctcaggtcgggccccatcgatgctggggctgcatcttccggctgtgtcgtcgacagcgtcgatgcccaaggagcgcctgtcgtgaggcgaagtgagcgcggcggagcaagtctaagcgtcgaggtgctcatgtgggcgccgatcgcgctggtgatcatcgggtttgttgtgggtatcggccggatgtcgatggcccaggacgcggtgagtggcgcggctggtgctgcggcccgtgcggcgtcgttggagcgtgatgggcagtcggctcagtctgcggcgcagcaggcggcgtcggcgaacctgtcgtccggtgggctggcatgtgcgccgagtgtgagcgtggacacgtcagtgtttgcccgtcctgccgggcaggcgggcacggttcacgccacggtcacgtgtgtcacctcgctgggtcttggattcgggtcccggacggtgcacgcaacggggtctgccccggtagacacctatcgggaaaggagaggctgagatggcccgcgatgagcgtggtggcggctcggtgtcggtgtggatgctgctcatggtgccagtgattctggtcatggccggcctggtttttgacgggtcccgtcagatatcggcaacccaggcggcccaggacgcggcggttgcggcatcccgcgccggaactgatgcggcagcgacaccgcagctagctggccacgacggggcggccgtagcagtccaagcggcccgccaggcactatctgctgccggggtggacgggtcggtgcaggaggacgggtcgaccatcacggtgaccacgtctcaaagtcggccgacagtgttcctgtcagcgatcggaatcagccaggtaagggggcatgggcaggcccatgctcagcttgtgggaccgggagaacgcccatgacagtgatacgtcgtatcggtgccctggtggcactgctggtggtgatagccggcttaccggccgggctcgtggccgcaggcgccccgctagtaccggcgggcctgtcatgggcccatgtgcggcatctgttggttaccccagacatgaccgggtcggtgctggtgtggctggtcagcctcatcggctggatcgggtgggcatggttcgccctggccgtcgcagccgaagcggtgacgatgctctcacggcagcggctgcactggcacatgcccggccctcgcctagtgcgccgagtggcagccggtcttctcattgccgcgttcgcggccgcaccggcagccacaagcacggctcacgccgccgaggccacccatgtggcggtcgccgcccaggctggaccggcacacgcggcccccgcccaggacagccccgccaccacctctcaggccccggacgcctccaccactccgaaaatctggaagacctacacggtgcgggccaacgactacctgtggaagatcgccgagcactactacggtgacggcgcccaattccgtcgtatcgccgaagcctccggtatcgacccgcactcagagctgaaagtcggccagaaactggtgctaccggttcccgagaacacggccgcgatccattcggttaaagcgggggagtatctgtgggagatcgccgagcactactacggtgacggcgcccagtaccataaaatcgcggaagcttccggtatcgatgcccattccgatctagccgtgggccaaaaactcgtcatccccgggcccctccgccacgacgccacgccgccacaccactcggcgtcgacccacgcgaag

SEQ ID NO: 240 - DNA, 2238 bp, Propionibacterium acnes
gacgccggccaccccaactactccgacccacacggtgaccccagctccggcctctgccggccactcgaccagcgacgagcacccactccatacggataccgccacagcggacaaggccagcgacgaggacgccctgtccccaatccaggtgggcttgaccgccagcgtcggactggtgctggtcgccggactgatcaccaccctcaaccgccgctaccggacccggttcacccgccagccccgcggcaaggccatgaccctgcccagcccggacgcccaaactgccgagatagcgctgcgcagcaccggggcgactgacactctgacgatcacctgcctcgaccaggcgctccgcgcgatcggcgcatggtgccaccactgcgggcacccgctgccacccctgctggccgcccgcgtcgacgacgaccggatcgacctgctgctatcccaggcggcccccgaccatcccgaggcggtggagctggccgccgacggatcggtgtggaccctcaccgccgaccggatcgacgacctgctagcccacaccgatgacaaccaagcggctccgtggccagctctagtcacactgggacgcgacgacgacggcgcccacatcctcatcgacttggaagccgcaggaaccttgcacctgatcgccgacgacgaccaggtcgacgcagccctcgccgccatcgccgtggaactggccacctgcgactggtccgacgaagtcaacgtcaccctcgtcggccaagtgtgcccgggcctagaagaggccttgggctctccaaccctgacccgcgccaccgacgtcgacgctctcttggagacgttggaggctcgcgccgacgatcagcgacacatcctcaccgaaggaaaccccctcgccgctcaccgagccgaccccgccatctccgacgggttcgacgccgaagtgatcctcctcgacaccgaactcaccgaagaccaccgcaaccgcctcgccagcctcgtcgaggctcttccccgcgtgtcagtcgccgcggtaacaaccagccccaccagcccacacgaatggtccctcaccctgacaggtgacccactagccgccgacctggctcccctcggctggcacatccacccccaaaccctctcccccgacctgtacaaccgcatggttgaactactcgccaactccgccgccgcagactacgaacccgccagctggtggaaccacgacgccgacgacgagcccaccaccgaccccaccaacgaggaagaatctaccccgagcaggcgagcccgcccgaatatccgcctgaccaccctgaccggcggcatcgacctatccagcgtcgacatcgacgacatcatcgacgaagccaaccaggccctcgacaacaccgaccagaccaccaaccaggttcgcgtcgacaccgaccaacccggcaccgacacccccttccccatcgacgacatcgacccgctgagctccgaccacccggtcctatccatcatcggccaccccgacatcacaggtgccactggaaccgttgggcgctccccgtggcgctgccaacagttggccctctacatcgctgagcatccgggagcatcgggggcgactatcgccgatgatttggggctatcagcgccgacggtgcgctcgattgctacacacctgcgacactggttgggagccgacgatgccggggtggcttacatgccggcggcgacgcgcggctaccggctcgatgagcggatcgtcacagatgtggacctgatcgacgctgctgtggccggggcaggcattaacaccgctgagacggccacactggtggccattttgaagctgggccgcggacgggtcttcgctggggttcctgactcggaacttcgccagttcagggcgtcgatgtaccacgtggaggcccgcatcgtcgatgctgccctccaagtgacagaccgggccctggaagccggagacttggggctggcccggtgggcgctgacccaagggctactggtgtctcccgatcatgaggacctggtcgccggttgtctgcgcaccgaataccaggccggcaacatggacaaggtcgccgagctggtcgatcacctgtcggctaccgcacgccgactgggcgtcgacctcaacgaggacaccacccggatcatcgatacggtcacccacgccgacaggagagcatcatgatctcccctgcactcatctccgtcaggaaggttcctatgcaccat

SEQ ID NO: 241 - DNA, 739 bp, Propionibacterium acnes
acgtgcgggtacacctaccagcaggcagccccggaaggcggttatcaggtcaccgcaatcacgtcgtgggatgtgacctggtcggtactaggacacacgggcacagtccatatcgagaaggccggtgggcagatgcttccggtcggcgagttggagtctgttgttacacggcgatgactcctgatagtccgacgctgtatgaggtgttgggggtctgccctgatgccactgatgaccagatcaagacggcgtggcgtcgtgccgcgaaagtgactcaccctgatgccggtggcactagtgaggcgttcgcggccgcccggcacgcctgggaggtgttgtctgatcctgcccggcgcaccgcctacgatgccgacctggcgggggaggatgatcccgacgacgaagccgccgacgccttcgacgttgatccgttcacggcatggccctggtgcgccccgtacatcgacgccacccccaccctgcgccacacctgccccggcacgatcaaggccatcgtggtcgccatcgccgggatcatggccggaatcggctggcaggaagcgctggaggccgtggtgtcgccgccggggtttctgggggcgtgctggatagtctcagtgccggttgtcgtcgcagtgacatggctggcagcggtgacgggtctggcatttttcaccatggcggccatctggtgtggatggtcgttgataggtggtgcgttgctgtggggccagacgtc

SEQ ID NO: 242 - DNA, 4920 bp, Propionibacterium acnes
ggccatcctgcggccgcaatagccgcgacggcgaccacccacacgatctgttgcatgggtctcatcatggcccatcatcgatgagtatgggtggccgacatggggtcactcgtagaggggatcgaggggtgtgcgggcgagcatggcttcctgtgtgccgagcatgagggtgccagagtcgtcgccggccgattcccagtcgacgatgatctgcccgctgtcgacgctggattcggtgatggtcacccattctccgtcgatattgatgagcaccccagcggccagctctgtggcagcaaccgggtgggctgggctgtagaggaggtcgatgtcgcgggcagggtcgtcgggttcttcggttacctcgggtggggtcgatctggctgtctcggtgtcgtcggccaggtcggctcccaggatgcgttcccattcggggctggttttcttgcccgctgaggccatcgtctcgtcgatctgttcgtcagtgggccacacaaatttctttttggtccaggtcgtggtgtcgggtcgcagctgatccagcagttccaggtcttgcggggagtgggccttgcgggggtcgggggtgtagaagaattggacttccttgggggctgattcgccggataggtaggtgccgcggccgcgtttgccgaacgggattcccacgccgacgtgttcggagccgaacatcatgcgggctccgtcagcggacaggggtccggtggcggcacgcccggagaagttgtctcggatttcgccgcccaggaactcggcgtcggggcgttgggtccccagatcgacgtggatacggcaggcggctgccatgcgcagcagggagccgatccagccgaaaacggggcattctccgggcatcccagagaccttgatcgttgaccaccagtttttcgcgttgccgtagaactggcggtactcgtcgatgaggaccagcacgcgggtgaagtcggtctcgcgggccccttcttcttcgatgcggcggtagcggtcctccatgagagaccacagccagtggatgagggcgacctggtcggggacggtagtggcgaccatctcgatgttgggccactcccgcaggcccaggtactcgatgcgtttagggtcgatgacgaagacgcgccagttgcggcgggcaccctcgacggcgtcgccgatcatggacaccgtttttccggtacgggtgcggccggccttgagctggtgggccatgacaccggagatgtcccagaaacaggtgttgccgtcctcgtcgacggcctgggggattttctcccagtctggggagtctgggcccggaagggccacgggtcggggcaccatcgagggcagggggtggcggcgggtgacggtgatggtgtcgtgttccaggtcgaagtcgctgcgccactggccgagcatcatcgccgaggtcaccgcggccaggcgcaattggatgttcgggctggacaaatgggcgccacgttggtggtgaatggtgaagccgtccaggttcccccgatcggttttccaggaatcgacggtgaccgccgacccatagatctgagtggctacttctttagcccgttccttgtctcggtccagatcggttttgtcagggtcaggggtcggggcgcggtattgcaggacgaaccggccggccgggatcgttgcggatgtcaccgtgaactctgccggcgaccaggcagccgcggccgcctgggtgagggccattggcatggtctcgacggcagcctcctcgggggggatggtgagggtcaggcgtcgcggatgcgtcttcttgcgattccatgtgactttctgcctcaccggcaccttcgccgccgactgaatggctaggcgagctgattcggcagtttcggtacgccggccagcgcgtagcgcccgtcgtgcgtgaaggctgcccaccacagcacagcccatacacggcagccaccagcgcggatcagcggctgctgcatagcccccggtagctagtaccgcacctgaccagccggccgcgatacttttccacgccggtttcgcaccaacagtcggggcagacgctggccgcttcgagaccgaggagggacgagacaagggagtgctggtcatgccgcggcctccttgtggcaggtcatttcacaggcatgccggccagcgatgatgccgtggcgcaccgccccggtagccgcatagaccgcgcacaactcaaacacggggcacccatcgcaggccgccgggttcatgctttctttgtcccacgatggtgggtcatcggtgcacggcacggccaggccatcctgttgagcggcgctgatagcggtgaataggcgcagctgggcgcgaacttggtctggggtcaggttgacggtgcgggctacacgcatggggttccttcctcttcaccagtgaaggttccctagacccggccgatgtgcggagggatttcagtgttttatcgaggtgaccagccagccggtctgcgctgcgggttcaggtaccagggtcagatgcaccacggtgtggtcggctaggggcacggcgaccaggggcccgtcggcgctcgccccggtgagggtgggagttccggccacggtggtggcgggaatctggttgggtttcgcggccatcagggagcccatgagggtcggggcggcgatctggacgagggcgactttgcgggcggcgggatcgcgggtcaaccagccgcgggtgaaggtgagcgcagccgacgtgatatcggggctcagcggggctggtgtggcggcggggtgggccgttgaggagggccatacgcgcggtagcgctggcgacatcgagcgggtcggagtggggtcaggtgtggggcttagggtccgatgtggcgatggggctaccgccccggtggtgggagacgagactggttgggggtggtgttgagggcgtgggatcagggtgaaggcagccaaactggccgggatgaggatgacggccgcgccgacacttcggagcgaggtcatgtgacgatccttcggtagctcgacgggttgccgtagatcttttccacgttgatgccactatgtgggttgtcggcgctaaccatttggcctccaccgatgtagacggccacgtggtgggcagggcttccccagaggatgaggtcgccgactttgagctggtcacgggccacagcagtgccgactttctgctggtcggcggcggtgcggggaaggctaatgccgatacgccggtacagcgccgaggtcaggcctgagcagtcgtagccgccatcggctttgccgttaccaccccacacgtaggcgtaggagttgttgtcggcgatcgatttggcccatgccacggcttcggccaggttcttcgacacaccggtctcgttagcggccccggtggcacagttgtttgacaggtgccctgtagtagtggatcccactatttgtttggccatggtttcccatttggcgtaggcatcgggcagggctgagccttgcactgcctgagctgcctgcgtcagcggcatcttctgccagtcagcgatgtcgactaaaccgggaatgtggaatccagggccgccggccgatccggggccagcgtaggtgatggtgtggcctttcaagaacgcctcggtggcgtaggcatcattgttgacctgatccagagtcccgtaccagcccggcaggatgcgctgctgaaaggggccggcgtcaccgtcaccgttagccttcgctgaggtagggtcggccccaagatctgattcttgtttggcggtcatgatagcgatgaccgctgcctgggtaggcagtttgtcacgctggaccacagtgacgatggtggtcacgagctgcttctgcctggccgtgaggcctccggcacccacagtgcctccggtgacggtacccacgcaagcatccccgccgacactgccaccgccgccgccagagttgtcgtcgagggccccagagcctactgacagcagcggcacaatgatcacggtcgctggcaagaccgccaggcccgccagcatcagcactgctgcactcaccacggcgatcacgtgagatgctttcaacgctgcccacctctcgctggtttgagggggcgacgcctgctggtacgcacaggcttggttgatccagtccgccgttgattggcaggcctgggtttgatcggcttgctgggacccggtttgggctccggagtcttaggctccggcttcacatgcctaggcacttcggctgcggtgggaggagtcagcacgtggcgtaccggcttggtgaccttctgggcacccgaaacaaccggcttagacaccaccttggcacctttgaccaccggtgcggctgccttcgcgccggccttcttgactgcacgatgcgctttgatagccccggcctcggcccggccaaccctactagcagtagcatcgagggctctgtggcccgtcgttgccctcaccggtgcatccttgccctggcgggtctgcttcgcgatcgccgacatgccgcctcgcaatgccgaaacatgattgtgggcgtgggcgatcgccgacatgccggccgtcgcgatttttgactggccctgcggggcccctgccccagcacgaatctgccggtaagccgccgacgtgccacgagcacccgccgccattcgcgccaccttcgcagccctagtcactcccgtcgacacgccacccgtggctaccgcagcagcacccgagaccacagtcgaggccatccgccttcgacccgatccggtgagcttgcgaccaccactgcgcaccatccggcgagcaccccgcccagcccactggccgatcaccgagcccctttcggaacgcttgctgcgcatccaatcgttgatcttgtccctcagccccttctcgcccttgtgacgacgccacatggacatcaagaacccgataatccc

SEQ ID NO: 243 - DNA, 4903 bp, Propionibacterium acnes
gcgataccgcaaggctgtgtgggatcagctgttcgggatggggcggttgcagccgctgttcgaaatcagcgacgccgaaaacatcatcgtggtgggtaaccatgaggtggttgtcgaccacaacgatggttcccggtcaacgctgccgccggtggccgactcggatgccgagctggaatcccagatcgcccggatggcgaggaatgcgaccccgcggcgagccttcgacgccgatcacaccgatgtgacgatcatgcaccaacagaagttccgtatccacgcgatctcttcggaggtgtcgttgcaaccgtcggtggtcatccgccaacatttgctcacccaaatcagtctgggggacctgtcccagcggggaatgatgccggtggaagtggcccggttcctcgatgaggcggtacaagctggcaagtccatcgtggtcgccggcgagcagggggcaggcaagacgacgtttttacgagcgttgatccacgccattccgatgcgggagcggttcgccacgttggagaccgatcaggagttgttcgctcatctgatgcctggccgggaaaacacgctggtgctgttcgcccgtgatggtaacggcgaggtggatccggcgactggcacccagcacggcgctatcgagatcgcccagctgattcctcctagcctgcgccaggcgttaactagggtcattgtcggtgaggtgcgcggcaatgaggcttcggccatgttccaggctatgcagtcggggactggcactatgagcagtatccactccccgcgagcctctgaggtgccgtcccggctagcccaaatgatttcgatgggcccggtctacgatctggatcaggccatgctgcagatcggtcattcgatcgactacatcgtctttgttcgtaagcgtgacctgcctgatgggagccggctgcgatttgttgagcagatccgttcagtctcgcctggtgattcgacaactcccagtcttggcgaggtgtacacggctgactcgtggacaggccagccgcttacgccactcatgcctggttcggccgccgacgagctgtctcacttcgcccgagacctggattactgcgaggcccactcatgaacactcccgcactaaccagcgccctcatcgtgaccgggctagggctgatcctggccatcgacgggctggtcccggcgccgcctcgacctggtgccccgctgagcccggcccaaaggtgggctcggctcacccaccgtcccactggtgcggccgggcgccgccgggacctgcgttgggggttggctgttcttgtcggtgtcgtgctgtttgtgctcaccgggtgggtggctgcgctggcgctgggccccatcattgtgttgttggcccccaccctgctgggggcggccccaccgaccgatattccgctgatggaggcgttggatcggtgggtgcgtcaggtcgctgcggtgctgccacaggggcgagacatcatcacagcggtgcggatctcacggccgcgggccccgaagctgatcgccgggtcggtggatcaactggtgtcccggttggatggccgtatggagccgagggaggcgttccagcggatggccgacgagctggactcggctgaggctgacgcggtgctggcctcactagcgttggcggccactcatccgcggggagcctcgacaacgttgaaggctattgctggcaacatccaacagcggttgaaagtgctgcggcaggtggaggctgagcggtctaagccgcgtaactcggtgcgccagatcacactggtcacgatcgccatgttcggggggctgctcgtgatcggacggtcgtttctggccccgctggcgacccctcccggtcaggtgctggtggccgtggcggtggtcatgtatgtcatcgcactagtgcagatgtatcggatggcgcggccccgtcgacgcacccggatcatggtcaggaggacccgatgaccattactgctttgtccctgctggccggggccatcgtcactgtcggactgctggtcatcgtggcagcgttccgcccagccccaggccctgacctggttgccgctctggaggtggtgtcgggtcgcacctcaagcgtcgccgagaacgtcgaccagacccggatcgggcggataggtcgcagcgtgacccgcacattccatgtgtcggtgtccccggccatgcgggccgcactgcgactccaaggcacgacccccgaagcgttctacggtcgacgcctgatctgcgcactgatcggggcgatcctgccgtggctgctcaacgcggtagccatcgcggtaggggcgaattccccgaacctactcatcccttcggcgctgtgtgtggcgttagctggcgctggatggatgctgccggcagcacggttgaaggctgcggccgggcccaccaacgatgactcgttcgaagcgctgctggtattcatcgatttggtcgtgctggaacggctcgccaacgaaacctccgtcgacgcgctcaccaatgcggcaaacatgtcggactcgccgctattcgtccagatccgtcaagtcctcaaccgtgcctccctggaaaacgtcgacccgtggaacgggctagaccggctagccgaggacatcaaactgcccgaactcaccgatgtggtctccatcgcccgcctccaaaacgaaggcgcctccctcgtcgacagtttccgggcccgagtcgccgagttgcgcgacgcctacctgctgcgcctgcaacaagaatccaccgccatcacccagcggcttggtttgtggacgatcctgcaagccggctcggtcatgctcatcttgctgggggcggccgccctcacactcatcacagccggataaaccgacatcgtgtcgagcccccatatgggccgcgaacctttcataatgatgcctgtaagcaccacaatattgatcacaacctaacaatgaaggagaaatcatgatgaccgatctcgacctggctaaaaaacagatcacctggctggcggcgcacctgcgttcccggatcgttgacgagcgtggcggtggtagctctaccgtggagacactgatttggattggtgtcatcgtggcgctggtgattggtgtgggcgtcggggtgacggcctatatcaggtcgaagatgcctcactgacgacgatgcgtagcaggttcacaactgatcagcgtggcggtggtagcgcgtcggtggggatgctcctgctgatgcctgcgatcatgctgctggcattcggtgggatcgaggtcgggatgtggtgtcacgcccatcagtcgaccatcgcggcagcccaaagcgccgcggaggctcagcgtgtcgtccatccggtcccggggtcggcacaggaggcagcctcgcagatcactagtcatggcggggtgcgtgatacccggatatcggtcagtgatgacggggccactgtcacggtgaccgtctcaggtcgggccccatcgatgctggggctgcatcttccggctgtgtcgtcgacagcgtcgatgcccaaggagcgcctgtcgtgaggcgaagtgagcgcggtggagcaagtctaagcgtcgaggtgctcatgtgggcgccgatcgcgctggtgatcatcgggtttgttgtgggtatcggccggatgtcgatggcccaggacgcggtgagtggcgcggcgggtgctgcggcccgtgcggcgtcgttggagcgtgatggacagtcggctcagtctgcggcgcagcaggcggcgtcggcgaacctgtcgtccggtgggctggcatgtgcgccgagtgtgagcgtggacacgtcagtgtttgcccgtcctgccgggcaggcgggcacggttcacgccacggtcacgtgtgtcacctcgctgggtcttgggttcgggtcccggacggtgcacgcaacggggtctgccccggtagacacctatcgggaaaggagaggctgagatggcccgtgatgagcgtggtggcggctcggtgtcggtgtggatgctgctcatggtgccggtgattctggtcatggccggcctggtttttgacgggtcccgtcagatatcggcaacccaggcggcccaggacgcggcggttgcggcatcccgcgccggaactgatgcggcagcgacaccgcagcttgctggccacgacggggcggccgtagcagtccaagcggcccgccaggcactatctgctgccggggtggacgggtcggtgcaggaggacgggtcgaccatcacggtgaccacgtctcaaagtcggccgacagtgttcctgtcagcgatcggaatcagccaggtaagggggcatgggcaggcccatgctcagcttgtgggaccgggagaacgcccatgacagtgatacgtcgtatcggtgccctggtggcactgctggtggtgatagccggcttaccggccgggctcgtggccgcaggcgccccgctagtaccctcgggcctgtcatgggcccatgtgcggcatctgttggttaccccagacatgaccgggtcggtgctggtgtggctggtcagcctcatcggctggatcgggtgggcatggttcgccctggccgtcgcagccgaagcggtgacgatgctctcagggcagcggctgcactggcacatgcccggccctcgcctagtgcgccgagtggcagccggtcttctcattgccgcgttcgcggccgcaccggcagccacaagcacggctcacgccgccgaggccacccatgtggcggtcgccgcccaggctggaccggcacacgcggccggcacccaggacagccccgccaccacctctcaggccccggacgcctccaccactccgaaaatctggaagacctacacggtgcgggccaacgactacctgtggaagatcgccgagcactactacggtgacggcgcc

SEQ ID NO: 244 - DNA, 4609 bp, Propionibacterium acnes
gataccgcaaggctgtgtgggatcagctgtgccgctctcccgacatggcagacagcaccctgcggactgactgacactgtggcgccgcggaggtctcccgcggcgtccgctggggcgagtgcatgcctgtcagctcatcttttatcgtcatgtttccccttgtcagagcggtctttgcaaagtgacaacgtcaggggtcttgacgacaacatcctcgacaacatcgtggcggtggtctgtgtctcgtcagttcaacgcaccggggaaagaggcaccgctgatgttcaccaccacaaacaccctcaacgatgagtgggaccagattcgcgccactgagatcgattggcatgactgccctgaactgatgcactgcatcgacgttgatgatgtgttggccgtcattcctgccgcccccgacgccatcttgggctacctcattgcccgggctcagggcggtgacgagttggccacccgcactatcatccaagcgttcacaggcaagcttatcttgatggccacggccaccaaggtgcgccgtactaatgacggcttcaatgatctgttggcgggtctgtgggagacgatcatcacgtacccgttggatcgtcgccctgacaagatcgctgcgaacctcatcctcgacacgttgcaccgggttacccggttctggcgtgctgattcccccgatgaggaagaggctcacggtctggtgcccttccctgacactctcatcgccccagagcccgatgaggacgtcacagctagccaggccatcgccttggcggtggaccgcaactggattaccgaggacctagcccgcctcatgagccatatttactgtgacggtatgactggagctgatgcgggtcgtctgcatggctgcgctccagctacggtgcgatctcgatgccgtgatggtcgggccgtgttgcagcgcaacgccgagacgatcctggccgtctgctgatccctctcttgctcatgcctgccgccaccctacccctacctgctagaaacatagccatgtctccagcaacgcatctagcgtatcttctagcaattgatctagctatgtatatagctgatgatctagctaccatatagctgtgtctccagcccaaaggacagcccaatggcatgcttgccacaggaaggtgcgtcagcctcccgaaatactggaaggagctttaccgtgcaggacatgacctcgaccagaccgattgaccgatccccgttcgaccgcactattgcggtgtggaaccacaaaggcggcacgttcaagacgtccgtcgtggcgaacctgggatacctgttcgccgccggtggcaacaaggtgctgctggtcgacatggacccccaggccaatctcgacattgacttcggtatacccgcgggagaacgtgaacggggcatgggattagccgaggcgctacgtgaggggacggcccttcccccaccgcagcatctcagcgaaaaccttcacctggtcagtggcggcgctgctctcaacgagttcaccgaccccgcatccttagcggccatcctcgaccgagtcaccaccgcacgctacgacctgctagctcaggcccttgccccgctggcctgggactatgacctcatcttcatcgactccgggccggcacaaactctgctgtcccagaccatccttggagtagcccgctggctggtagtgcccacccgcaccgataacgcctcaatcactggcctcgtcgacgttcaagacgccatcgacggggttgcctcctgcaaccctgaccttcaactactcggcgttgtcctagccggcgtgggggcccgggccacccggatcgccgcagataaacgccacgccatcgacacagtgctgggggcaggaaccgttttcgatgcggtcatccactactccgagaaggtgtccgtgctcgcacgccagcagggcaagaccgtcgccgagctagccaacgagtaccacaacacccagcccgcctacacctacctagctaaaggccagaacatccccaacgtcgccaaggcagccgtcagcatcgaaactgattatctgaggctggccaccgagatcagcgaccgcatgttcaccagcgacgagcaggagcctgatcatgactgacgatccgactccatccgagcagaacaaccccaccagcgacgacatgcgcttggccgaagaatgggccaacagcggccgcacagtgggagccctgccgcgccgtcaacggcctcagcgacccacaccccgcaccaccagccaaccccctgtctcgtcccctgacacaccggctccgaaaaaaccccagaagacccccaccagccagcctggccgtcaacggatcaacgtcaccgtctacgttgtgcccgaactccatgagcggctgcgctcccgatcggcggcgacgggggtgacggtctcggatctggtggtgcatgcgttagcgttcgtcgccgatcatgcgggggaggcgatcgccgatgatctgcgcgtcgagacgggccccggcatgggggccggactgttcgatgtgaccccatcgcggccagtaggggtcgccaaaacccagctgggggtgcgaatgacccgccacaacaaggatggtttggaccagctgacccggacgagtggagcccgtgaccgcagccatcttgtgtctgtcgccgtgcgcgactatctcgactccaaccctgtaaagaaaggccgacatgtccgctgatgaaactcctgccgcccggggtgggcgacgctttgatacgaccgtcaagcccaggcgccgtcccatgcttatcgccgccggtatcgccatcgtgatagtcggcgcgctcctcatcactcagttgattcgctccgcccaaaccgagcatcgcgtgctggaagtccacgccgatgtggctcgcggcgaggtcatccgtgacaccgatctggtatcggtgactgtcggccaggtcgacaacgtatcaacggttcccgcagaccagctcgactcactggtcggcaaacgcgccacggcagatcttcgagccggatcactcttgcctgctggggctatcggcccggccgatgtcgttccagctccgggcaagtcgctggtcgggctgaagctagccgccggacagatccctatcggagaccttgctgtcgggacgaagctgcgcctgatccagacgtcggcacccagcggctcatccaccaccactgatagcagcaccaataccgatggccagtcgtgggaggcaacaatggcgaccggcaccaaaaagaccgagcaggtcaccttgatcaacgccgaagtgaactcgcgtgatgccgcccggatcgcccaactgacgtcacagggccgtatcgccgtagtgaaggatccgatccgatgagcaccattgttttgaccagcgtctcgggagccccaggggtcaccacgacagcgatcgggctgggcagggtctggccacaatcgagcctggtcgtcgaggatgacacccaccacgccatgctggcgggctacctgcgagcctcccagcacgccgaaccgaacctggccgcagtggcgaacctgacgtcgactccaaccaacgcccaaacggtgtgggaatctatcgccagacccctacccaccgatgacccagtcggcgggctgcgacgcaaaggcatcctcggcccgcccacgccgtggtctcgcgcaggcatcgacccccgatggggattcatgctggccctgtggcggcaactggaggaggctggcatcgacaccatcatcgatttgggtcgcctagccacaccactgacctcaacgccacacctgatcgccgcacccatcgtcgaggacgccgacatgatcttggtgatgatcgaggcgacactacgcgacatcgccggcgcccgcacgatggtggagggactcgctgagcagatgaacttggccggcgcctaccgacgtctcggactgcttgtccaccgtggcggccaggcccgcggcgtcgccgagttcaatgacaaggagatcacctcggcgttacgactcccggtcatcggggccattacccacgacccggccggagccgcccaactctccgacggggtcgggcagcggttcgacaagtcacgtctggcccactcactatcaaaggtggcggccagcctcgtcgatgccataaacaagcgccacgctgatgacgaggaggatctgtgatggccagttttgctgataatccgttcgacaagctgcgctcccaggatgcggcaagagcttcggtagagcaggagcctgatgccggattagcgtcggagttgttttcgacgtcgtcggggtgggccagctctcagcaggtgtcccaagctcaaccggtgatgacccgttcggagaacgtggattggccggttgtcgcggagctagccagtacggccactgatgaggttgaggctgagatcagcaggtggagttccactcatgatggggtggcgacgctagacattcgccaggccatcgcggagcctgctattgcctcggcggtgtctacgtatgctgaccgacgccagatcgatgtaggggagacctggcctgatctggtacgccagcgataccgcaaggctgtgtgggatcag

SEQ ID NO: 245 - DNA, 4613 bp, Propionibacterium acnes
gcgataccgcaaggctgtgtgggatcagctgtgccgctctcccgacatggcagacagcaccctgcggactgactgacactgtggcgccgcggaggtctcccgcggcgtccgctggggcgagtgcatgcctgtcagctcatcttttatcgtcatgtttccccttgtcagagcggtctttgcaaagtgacaacgtcaggggtcttgacgacaacatcctcgacaacatcgtggcggtggtctgtgtctcgtcagttcaacgcaccggggaaagaggcaccgctgatgttcaccaccacaaacaccctcaacgatgagtgggaccagattcgcgccactgagatcgattggcatgactgccctgaactgatgcactgcatcgacgttgatgatgtgttggccgtcattcctgccgcccccgacgccatcttgggctacctcattgcccgggctcagggcggtgacgagttggccacccgcactatcatccaagcgttcacaggcaagcttatcttgatggccacggccaccaaggtgcgccgtactaatgacggcttcaatgatctgttggcgggtctgtgggagacgatcatcacgtacccgttggatcgtcgccctgacaagatcgctgcgaacctcatcctcgacacgttgcaccgggttacccggttctggcgtgctgattcccccgatgaggaagaggctcacggtctggtgcccttccctgacactctcatcgccccagagcccgatgaggacgtcacagctagccaggccatcgccttggcggtggaccgcaactggattaccgaggacctagcccgcctcatgagccatatttactgtgacggtatgactggagctgatgcgggtcgtctgcatggctgcgctccagctacggtgcgatctcgatgccgtgatggtcgggccgtgttgcagcgcaacgccgagacgatcctggccgtctgctgatccctctcttgctcatgcctgccgccaccctacccctacctgctagaaacatagccatgtctccagcaacgcatctagcgtatcttctagcaattgatctagctatgtatatagctgatgatctagctaccatatagctgtgtctccagcccaaaggacagcccaatggcatgcttgccacaggaaggtgcgtcagcctcccgaaatactggaaggagctttaccgtgcaggacatgacctcgaccagaccgattgaccgatccccgttcgaccgcactattgcggtgtggaaccacaaaggcggcacgttcaagacgtccgtcgtggcgaacctgggatacctgttcgccgccggtggcaacaaggtgctgctggtcgacatggacccccaggccaatctcgacattgacttcggtatacccgcgggagaacgtgaacggggcatgggattagccgaggcgctacgtgaggggacggcccttcccccaccgcagcatctcagcgaaaaccttcacctggtcagtggcggcgctgctctcaacgagttcaccgaccccgcatccttagcggccatcctcgaccgagtcaccaccgcacgctacgacctgctagctcaggcccttgccccgctggcctgggactatgacctcatcttcatcgactccgggccggcacaaactctgctgtcccagaccatccttggagtagcccgctggctggtagtgcccacccgcaccgataacgcctcaatcactggcctcgtcgacgttcaagacgccatcgacggggttgcctcctgcaaccctgaccttcaactactcggcgttgtcctagccggcgtgggggcccgggccacccggatcgccgcagataaacgccacgccatcgacacagtgctgggggcaggaaccgttttcgatgcggtcatccactactccgagaaggtgtccgtgctcgcacgccagcagggcaagaccgtcgccgagctagccaacgagtaccacaacacccagcccgcctacacctacctagctaaaggccagaacatccccaacgtcgccaaggcagccgtcagcatcgaaactgattatctgaggctggccaccgagatcagcgaccgcatgttcaccagcgacgagcaggagcctgatcatgactgacgatccgactccatccgagcagaacaaccccaccagcgacgacatgcgcttggccgaagaatgggccaacagcggccgcacagtgggagccctgccgcgccgtcaacggcctcagcgacccacaccccgcaccaccagccaaccccctgtctcgtcccctgacacaccggctccgaaaaaaccccagaagacccccaccagccagcctggccgtcaacggatcaacgtcaccgtctacgttgtgcccgaactccatgagcggctgcgctcccgatcggcggcgacgggggtgacggtctcggatctggtggtgcatgcgttagcgttcgtcgccgatcatgcgggggaggcgatcgccgatgatctgcgcgtcgagacgggccccggcatgggggccggactgttcgatgtgaccccatcgcggccagtaggggtcgccaaaacccagctgggggtgcgaatgacccgccacaacaaggatggtttggaccagctgacccggacgagtggggcccgtgaccgcagccatcttgtgtctgtcgccgtgcgcgactatctcgactccaaccctgtaaagaaaggccgacatgtccgctgatgaaactcctgccgcccggggtgggcgacgctttgatacgaccgtcaagcccaggcgccgtcccatgcttatcgccgccggtatcgccatcgtgatagtcggcgcgctcctcatcactcagttgattcgctccgcccaaaccgagcatcgcgtgctggaagtccacgccgatgtggctcgcggcgaggtcatccgtgacaccgatctggtatcggtgactgtcggccaggtcgacaacgtatcaacggttcccgcagaccagctcgactcactggtcggcaaacgcgccacggcagatcttcgagccggatcactcttgcctgctggggctatcggcccggccgatgtcgttccagctccgggcaagtcgctggtcgggctgaagctagccgccggacagatccctatcggagaccttgctgtcgggacgaagctgcgcctgatccagacgtcggcacccagcggctcatccaccaccactgatagcagcaccaataccgatggccagtcgtgggaggcaacaatggcgaccggcaccaaaaagaccgagcaggtcaccttgatcaacgccgaagtgaactcgcgtgatgccgcccggatcgcccaactgacgtcacagggccgtatcgccgtagtgaaggatccgatccgatgagcaccattgttttgaccagcgtctcgggagccccaggggtcaccacgacagcgatcgggctgggcagggtctggccacaatcgagcctggtcgtcgaggatgacacccaccacgccatgctggcgggctacctgcgagcctcccagcacgccgaaccgaacctggccgcagtggcgaacctgacgtcgactccaaccaacgcccaaacggtgtgggaatctatcgccagacccctacccaccgatgacccagtcggcgggctgcgacgcaaaggcatcctcggcccgcccacgccgtggtctcgcgcaggcatcgacccccgatggggattcatgctggccctgtggcggcaactggaggaggctggcatcgacaccatcatcgatttgggtcgcctagccacaccactgacctcaacgccacacctgatcgccgcacccatcgtcgaggacgccgacatgatcttggtgatgatcgaggcgacactacgcgacatcgccggcgcccgcacgatggtggagggactcgctgagcagatgaacttggccggcgcctaccgacgtctcggactgcttgtccaccgtggcggccaggcccgcggcgtcgccgagttcaatgacaaggagatcacctcggcgttacgactcccggtcatcggggccattacccatgacccggccggagccgcccaactctccgacggggtcgggcagcggttcgacaagtcacgtctggcccactcactatcaaaggtggcggccagcctcgtcgatgccataaacaagcgccacgctgatgacgaggaggatctgtgatggccagttttgctgataatccgttcgacaagctgcgctcccaggatgcggcaagagcttcggtagagcaggagcctgatgccggattagcgtcggagttgttttcgacgtcgtcggggtgggccagctctcagcaggtgtcccaagctcaaccggtgatgacccgttcggagaacgtggattggccggttgtcgcggagctagccagtacggccactgatgaggttgaggctgagatcagcaggtggagttccactcatgatggggtggcgacgctagacattcgccaggccatcgcggagcctgctattgcctcggcggtgtctacgtatgctgaccgacgccagatcgatgtaggggagacctggcctgatctggtacgccagcgataccgcaaggctgtgtgggatcagct

SEQ ID NO: 246 - DNA, 4903 bp, Propionibacterium acnes
gcgataccgcaaggctgtgtgggatcagctgttcgggatggggcggttgcagccgctgttcgaaatcagcgacgccgaaaacatcatcgtggtgggtaaccatgaggtggttgtcgaccacaacgatggttcccggtcaacgctgccgccggtggccgactcggatgccgagctggaatcccagatcgcccggatggcgaggaatgcgaccccgcggcgagccttcgacgccgatcacaccgatgtgacgatcatgcaccaacagaagttccgtatccacgcgatctcagcggaagtgtcattgcaaccgtcggtggtcatccgccaacatttgctcacccaaatcagtctgggggacctgtcccagcggggaatgatgccggtggaagtggcccggttcctcgatgaggcggtacaagctggcaagtccatcgtggtcgccggcgagcagggggcaggcaagacgacgtttttacgagcgttgatccacgccattccgatgcgggagcggttcgccacgttggagaccgatcaggagttgttcgctcatctgatgcctggccgggaaaacacgctggtgctgttcgcccgtgatggtaacggcgaggtggatccggcgactggcacccagcacggcgctatcgagatcgcccagctgattcctcctagtctgcgccaggcgttaactagggtcattgtcggtgaggtgcgcggcaatgaggcttcggccatgttccaggctatgcagtcggggactggcactatgagcagtatccactccccgcgagcctctgaggtgccgtcccggctagcccaaatgatttcgatgggcccggtctacgatctggatcaggccatgctgcagatcggtcattcgatcgactacatcgtctttgttcgtaagcgtgacctgcctgatgggagccggctgcgatttgttgagcagatccgttcagtctcgcctggtgattcgacaactcccagtcttggcgaggtgtacacggctgactcgtggacaggccagccgcttacgccactcatgcctggttcggccgccgacgagctgtctcatttcgcccgagacctggattactgcgaggcccactcatgaacactcctgcactaaccagcgccctcatcgtgaccgggttggggctgatcctggccatcgacgggctggtcccggcgccgcctcgacctggtgccccgctgagcccggcccagaggtgggctcggctcacccaccgtcccacaggagcggccgggcgtcgccgggatttgcgttgggggttggctgttctcgtcggcgtcgtgctgtttgtgctcaccgggtgggtggctgcgctggcgttgggccccatcattgtgttgttggcccccaccctgctgggggcggccccaccgaccgatattccgctgatggaggcgttggatcggtgggtgcgtcaggtcgctgcggtgctgccacaggggcgagacatcatcacagcggtgcggatctcacggccgcgggccccgaagctgatcgccgggtcggtggatcaactggtgtcccggttggatggccgtatggagccgagagaggcgttccagcggatggccgacgagctggactcggctgaggctgacgcggtgctggcctctctggcgttggcggccactcatccgcggggagcctcgacaacgttgaaggctattgctggcaacatccaacagcggttgaaagtgctgcggcaggtggaggctgagcggtctaagccgcgtaactcggtgcgccagatcacactggtcacgatcgccatgttcggggggctgctcgtgatcggacggtcgtttctggccccgctggcgacccctcccggtcaggtgctggtggccgtggcggtggtcatgtatgtcatcgcactagtgcagatgtatcggatggcgcggccccgtcgacgcacccggatcatggtcaggaggacccgatgaccattactgctttgtccctgctggccggggccatcgtcactgtcggactgctggtcatcgtggcagcgttccgcccagccccaggccctgacctggttgccgctctggaggtggtgtcgggtcgcacctcaagcgtcgccgagaacgtcgaccagacccggatcgggcggataggtcgcagcgtgacccgcacattccatgtgtcggtgtccccggccatgcgggccgcactgcgactccaaggcacgacccccgaagcgttgtacggtcgacgcctgatctgcgcactgatcggggcgatcctgccgtggctgctcaacgcggtagccatcgcggtaggggcgaattccccgaacctactcatcccttcggcgctgtgtgtggcgttagctggcgctggatggatgctgccggcagcacggttgaaggctgcggccgggcccaccaacgatgactcgttcgaagcgctgctggtattcatcgatttggtcgtgctggaacggctcgccaacgaaacctccgtcgacgcgctcaccaatgcggcaaacatgtcggactcgccgctattcgtccagatccgtcaagtcctcaaccgtgcctccctggaaaacgtcgacccgtggaacgggctagaccggctagccgaggacatcaaactgcccgaactcaccgatgtggtctccatcgcccgcctccaaaacgaaggcgcctccctcgtcgacagtttccgggcccgagtcgccgagttgcgcgacgcttacctgctgcgcctgcaacaagaatccaccgccatcacccagcggcttggtttgtggacgatcctgcaagccggctcggtcatgctcatcttgctgggggcggccgccctcacactcatcacagccggataaaccgacatcgtgtcgagcccccatatgggccgcgaacctttcataatgatgcctgtaagcaccacaatattgatcacaacctaacaatgaaggagaaatcatgatgaccgatctcgacctggctaaaaaacagatcacctggctggcggcgcacctgcgttcccggatcgttgacgagcgtggcggtggtagctctaccgtggagacactgatttggattggtgtcatcgtggcgctggtgattggtgtgggcgtcggggtgacggcctatatcaggtcgaagatgcctcactgacgacgatgcgtagcaggttcacaactgatcagcgtggcggtggtagcgcgtcggtggggatgctcctgctgatgcctgcgatcatgctgctggcattcggtgggatcgaggtcgggatgtggtgtcacgcccatcagtcgaccatcgcggcagcccaaagcgccgcggaggctcagcgtgtcgtccatccggtcccggggtcggcacaggaggcagcctcgcagatcactagtcatggcggggtgcgtgatacccggatatcggtcagtgatgacggggccactgtcacggtgaccgtggtgggccgggccccatcgatgctggggctgcatcttccggctgtgtcgtcgacagcgtcgatgcccaaggagcgcctgtcgtgaggcgaagtgagcgcggtggagcaagtctaagcgtcgaggtgctcatgtgggcgccgatcgcgctggtgatcatcgggtttgttgtgggtatcggccggatgtcgatggcccaggacgcggtgagtggcgcggctggtgctgcggcccgtgcggcgtcgttggagcgtgatggacagtcggctcagtctgcggcgcagcaggcggcgtcggcgaacctgtcgtccggtgggctggcatgtgcgccgagtgtgagcgtggacacgtcagtgtttgcccgtcctgccgggcaggcgggcacggttcacgccacggtcacgtgtgtcacctcgctgggtcttgggttcgggtcccggacggtgcacgcaacggggtctgccccggtagacacctatcgggaaaggagaggctgagatggcccgtgatgagcgtggtggcggctcggtgtcggtgtggatgctgctcatggtgccggtgattctggtcatggccggcctggtttttgacgggtcccgtcagatatcggcaacccaggcggcccaggacgcggcggttgcggcatcccgcgccggaactgatgcggcagcgacaccgcagcttgctggccacgacggggcggccgtagcagtccaagcggcccgccaggcactatctgctgccggggtggacgggtcggtgcaggaggacgggtcgaccatcacggtgaccacgtctcaaagtcggccgacagtgttcctgtcagcgatcggaatcagccaggtgaccgggcatgggcaggcccatgctcagcttgtgggaccgggagaacgcccatgacagtgatacgtcgtatcggtgccctggtggcactgctggtggtgatagccggcttaccggccgggctcgtggccgcaggcgccccgctagtaccctcgggcctgtcatgggcccatgtgcggcatctgttggttaccccagacatgaccgggtcggtgctggtgtggctggtcagcctcatcggctggatcgggtgggcatggttcgccctggccgtcgcagccgaagcggtgacgatgctctcagggcagcggctgcactggcacatgcccggccctcgcctagtgcgccgagtggcagccggtcttctcattgccgcgttcgcggccgcaccggcagccacaagcacggctcacgccgccgaggccacccatgtggcggtcgccgcccaggctggaccggcacacgcggcccccgcccaggacagccccgccaccacctctcaggccccggacgcctccaccactccgaaaatctggaagacctacacggtgcgggccaacgactacctgtggaagatcgccgagcactactacggtgacggcgcc

SEQ ID NO: 247 - DNA, 4612 bp, Propionibacterium acnes
gcgataccgcaaggctgtgtgggatcagctgtgccgctcccccgacatggcagacagcaccctgcggactgactgacactgtggcgccgcggaggtctcccgcggcgtccgctggggcgagtgcatgcctgtcagctcatcttttatcgtcatgtttccccttgtcagagcggtctttgcaaagtgacaacgtcaggggtcttgacgacaacatcctcgacaacatcgtggcggtggtctgtgtcttgtcagttcaacgcaccggggaaagaggcaccgctgatgttcaccaccacaaacaccctcaacgatgagtgggaccagattcgcgccactgagatcgattggcatgactgccctgaactgatgcactgcatcgacgttgatgatgtgttggccgtcattcctgccgcccccgacgccatcttgggctacctcattgcccgggctcagggcggtgacgagttggccacccgcactatcatccaagcgttcacaggcaagcttattttgatggccacggccaccaaggtgcgccgtactaatgacggcttcaatgatctgttggcgggtctgtgggagacgatcatcacgtacccgttggatcgtcgccctgacaagatcgctgcgaacctcatcctcgacacgttgcaccgggttacccggttttggcgtgctgattcccccgatgaggaagaggctcacggtctggtgcccttccctgacactctcatcgccccagagcccgatgaggacgtcacagctagccaggccatcgccttggcggtggaccgcaactggattaccgaggacctagcccgcctcatgagccatatttactgtgacggtatgactggagctgatgcgggtcgtctgcatggctgcgctccagctacggtgcgatctcgatgccgtgatggtcgggccgtgttgcagcgcaacgccgagacgatcctggccgtctgctgatccctctcttgctcatgcctgccgccaccctacctctacctgctagaaacatagccatgtctccagcaacgcatctagcgtatcttctagcaattgatctagctatcatatagctgatgatctagctatcatatagctgtgtctccagcccaaaggacagcccaatggcatgcttgccacaggaaggtgcgtcagcctcccgaaatactggaaggagctttaccgtgcaggacatgacctcgaccagaccgattgaccgatccccgttcgaccgcactattgcggtgtggaaccacaaaggcggcacgttcaagacgtccgtcgtggcgaacctgggatacctgttcgccgccggtggcaacaaggtgttgatggtcgacatggacccccaggccaatctcgacattgacttcggtatacccgcgggagaacgtgaacggggcatgggattagccgaggcgctacgtgaggggacggcccttcccccaccgcagcatctcagcgaaaaccttcacctggtcagtggcggcgctgctctcaacgagttcaccgaccccgcatccttagcggccatcatcgagcgggtcaccaccgcacgctacgacctgctagctcaggcccttgccccgctggcctgggactatgacctcatcttcatcgactccgggccggcccaaactctgctgtcccagaccatccttggagtagcccgctggctggtagtgcccacccgcaccgataacgcctcaatcactggcctcgtcgacgttcaagacgccatcgacggggttgcctcctgcaaccctgaccttcaactactcggcgttgtcctagccggcgtgggggcccgggccacccggatcgccgcagataaacgccacgccatcgacacagtgctgggggcaggaaccgttttcgatgcggtcatccactactccgagaaggtgtccgtgctcgcacgccagcagggcaagaccgtcgccgagctagccaacgagtaccacaacacccagcccgcctacacctacctagctaaaggccagaacatccccaacgtcgccaaggcagccgtcagcatcgaaactgattatctgaggctggccaccgagatcagcgaccgcatgttcaccagcgacgagcaggagcctgatcatgactgacgatccgactccatccgagcagaacaaccccaccagcgacgacatgcgcttggccgaagaatgggccaacagcggccgcacagtgggagccctgccgcgccgtcaacggcctcagcgacccacaccccgcaccaccagccaaccccctgtctcgtcccctgacacaccggctccgaaaaaaccccagaagacccccaccagccagcctggccgtcaacggatcaacgtcaccgtctacgttgtgcccgaactccatgagcggctgcgctcccgatcggcggcgacgggggtgacggtctcggatctggtggtgcatgcgttagcgttcgtcgccgatcatgcgggggaggcgatcgccgatgatctgcgcgtcgagacgggccccggcatgggggccggactgttcgatgtgaccccatcgcggccagtaggggtcgccaaaacccagctgggggtgcgaatgacccgccacaacaaggatggtttggaccagctgacccggacgagtggagcccgtgaccgcagccatcttgtgtctgtcgccgtgcgcgactatctcgactccaaccctgtaaagaaaggccgacatgtccgctgatgaaactcctgccgcccggggtgggcgacgctttgatacgaccgtcaagcccaggcgccgtcccatgcttatcgccgccggtatcgccatcgtgatagtcggcgcgctcctcatcactcagttgattcgctccgcccaaaccgagcatcgcgtgctggaagtccacgccgatgtggctcgcggcgaggtcatccgtgacaccgatctggtatcggtgactgtcggccaggtcgacaacgtatcaacggttcccgcagaccagctcgactcactggtcggcaaacgcgccacggcagatcttcgagccggatcactcttgcctgctggggctatcggcccggccgatgtcgttccagctccgggcaagtcgctggtcgggctgaagctagccgccggacagatccctatcggagaccttgctgccgggacgaagctgcgcctgatccagacgtcggcacccagcggctcatccaccaccactgatagcagcaccaataccgatggccagtcgtgggaggcaacaatggcgaccggcaccaaaaagaccgagcaggtcaccttgatcaacgccgaagtgaactcgcgtgatgccgcccggatcgcccaactgacgtcacagggccgtatcgccgtagtgaaggatccgatccgatgagcaccattgttttgaccagcgtctcgggagccccaggggtcaccacgacagcgatcgggctgggcagggtctggccacaatcgagcctggtcgtcgaggatgacacccaccacgccatgctggcgggctacctgcgagcctcccagcacgccgaaccgaacctggccgcagtggcgaacctgacgtcgactccaaccaacgcccaaacggtgtgggaatctatcgccagacccctacccaccgatgacccagtcggcgggatgcgacgcaaaggcatcctcggcccgcccacgccgtggtctcgcgcaggcatcgacccccgatggggattcatgctggccctgtggcggcaactggaggaggctggcatcgacaccatcatcgatttgggtcgcctagccacaccactgacctcaacgccacacctgatcgccgcacccatcgtcgaggacgccgacatgatcttggtgatgatcgaggcgacactacgcgacatcgccggcgcccgcacgatggtggagggactcgctgagcagatgaacttggccggcgcctaccgacgtctcggactgcttgtccaccgtggcggccaggcccgcggcgtcgccgagttcaatgacaaggagatcacctcggcgttacgactcccggtcatcggggccattacccatgacccggccggagccgccgaactctccgacggggtcgggcagcggttcgacaagtcacgtctggcccactcactatcaaaggtggcggccagcctcgtcgatgccataaacaagcgccacgctgatgacgaggaggatctgtgatggccagttttgctgataatccgttcgacaagctgcgctcccaggatgcggcaagagcttcggtagagcaggagcctgatgccggattagcgtcggagttgttttcgacgtcgtcggggtgggccagctctcagcaggtgtcccaagctcaaccggtgatgacccgttcggagaacgtggattggccggttgtcgcggagctagccagtacggccactgatgaggttgaggctgagatcagccggtggagttccactcatgatggggtggcgacgctagacattcgccaggccatcgcggagcctgctattgcctcggcggtgtctacgtatgctgaccgacgccagatcgatgtaggggagacctggcctgatctggtacgccagcgataccgcaaggctgtgtgggatcagct

SEQ ID NO: 248 - DNA, 4896 bp, Propionibacterium acnes
gcgataccgcaaggctgtgtgggatcagctgttcgggatggggcggttgcagccgctgttcgaaatcagcgacgccgaaaacatcatcgtggtgggtaaccatgaggtggttgtcgaccacaacgatggttcccggtcaacgctgccgccggtggccgactcggatgccgagctggaatcccagatcgcccggatggcgaggaatgcgaccccgcggcgagccttcgacgccgatcacaccgatgtgacgatcatgcaccaacagaagttccgtatccacgcgatctcagcggaagtgtcattgcaaccgtcggtggtcatccgccaacatttgctcacccaaatcagtctgggggacctgtcacatcgcggaatgatgccggtggaagtggcccggttcctcgatgaggcggtacaagctggcaagtccatcgtggtcgccggcgagcagggggcaggcaagacgacgtttttacgagcgttgatccacgccattccgatgcgggagcggttcgccacgttggagaccgatcaggagttgttcgctcatctgatgcctggccgggaaaacacgctggtgctgttcgcccgtgatggtaacggcgaggtggatccggcgactggcacccagcacggcgctatcgagatcgcccagctgattcctcctagcctgcgccaggcgttaactagggtcattgtcggtgaggtgcgcggcaatgaggcctcggccatgttccaggccatgcagtcgggtacaggcaccatgagcagtatccactccccgcgagcctctgaggtgccgtcccggctagcccaaatgatttcgatgggcccggtctacgatctggatcaggccatgctgcagatcggtcattcgatcgactacatcgtctttgttcgtaagcgtgacctgcctgatgggagccggctgcgatttgttgagcagatccgttcagtctcgcctggtgattcgacaactcccagtcttggcgaggtgtacacggctgactcgtggacaggccagccgcttacgccactcatgcctggttcggccgccgacgagctgtctcacttcgcccgagacctggattactgcgaggcccactcatgaacactcccgcactaaccagcgccctcatcgtgaccgggctagggctgatcctggccatcgacgggctggtcccggcgccgcctcgacctggtgccccgctgagcccggcccaaaggtgggctcggctcacccaccgtcccactggtgcggccgggcgtcgccgggatttgcgttgggggttggctgttcttgtcggtgtcgtgctgtttgtgctcaccgggtgggtggctgcgctggcgctgggccccatcattgtgttgttggcccccaccctgctgggggcggccccaccgaccgatattccgctgatggaggcgctggatcgctgggtgcgtcaggtcgctgcggtgctgccacaggggcgcgacatcatcacagcggtgcggatctcacggccgcgggccccgaagctgatcgccgggtcggtggatcaactggtgtcccggttggatggccgtatggagccgagggaggcgttccagcggatggccgacgagctggactcggctgaggctgacgcggtgctggcctcactagcgttggcggccactcatccgcggggagcctcgacaacgttgaaggctattgctggcaacatccaacagcggttgaaagtgctgcggcaggtggaggctgaacggtctaagccgcgtaactcggtgcgccagatcacactggtcacgatcgccatgttcggggggctgctcgtgatcggacggtcgtttctggccccgctggcgacccctcccggtcaggtgctggtggccgtggcggtggtcatgtatgtcatcgcactagtgcagatgtatcggatggcgcggccccgtcgacgcacccggatcatggtcaggaggacccgatgaccattactgctttgtccctgctagccggggccatcgtcactgtcggactgctggtcatcgtggcagcgttccgcccagccccaggccctgacctggttgccgctctggaggtggtgtcgggtcgcacctcaagcgtcgccgagaacgtcgaccagacccggatcgggcggataggtcgcagcgtgacccgcacattccatgtgtcggtgtccccggccatgcgggccgcactgcgactccaaggcacgacccccgaagcgttctacggtcgacgcctgatctgcgcactgatcggggcgatcctgccgtggctgctcaacgcggtagccatcgcggtaggggcgaattccccgaacctactcatcccttcggcgctgtgtgtggcgttagctggcgctggatggatgctgccggcagcacggttgaaggctgcggccgggcccaccaacgatgactcgttcgaagcgctgctggtattcatcgatttggtcgtgctggaacggctcgccaacgaaacctccgtcgacgcgctcaccaatgcggcaaacatgtcggactcgccgctattcgtccagatccgtcaagtcctcaaccgtgcctccctggaaaacgtcgacccgtggaacgggctagaccggctagccgaggacatcaaactgcccgaactcaccgatgtggtctccatcgcccgcctccaaaacgaaggcgcctccctcgtcgacagtttccgggcccgagtcgccgagttacgcgacgcctacctgctgcgcctgcaacaagaatccaccgccatcacccagcggcttggtttgtggacgatcctgcaagccggctcggtcatgctcatcttgctgggggcggccgccctcacactcatcacagccggataaaacgacaccgtgtcgagcccccatatgggccgcgaacctttcataatgatgcctgtaagcaccacaatattgatcacaacctaacaatgaaggagaaatcatgatgaccgatctcgacctggctaaaaaacagatcacctggctggcggcgcacctgcgttcccggatcgttgacgagcgtggcggtggtagctctaccgtggagacactgatttggattggtgtcatcgtggcgctggtgattggtgtgggcgtcggggtgacggcctatatcaggtcgaagatgcctcactgacgacgatgcgtagcaggttcacaactgatcagcgtggcggtggtagcgcgtcggtggggatgctcctgctgatgcctgcgatcatgctgctggcattcggtgggatcgaggtcgggatgtggtgtcacgcccatcagtcgaccatcgcggcagcccaaagcgccgcggaggctcagcgtgtcgtccatccggtcccggggtcggcacaggaggcagcctcgcagatcactagtcatggcggggtgcgtgatgcgcggatatcggtcagtgatgacggggccactgtcacggtgaccgtctcaggtcgggccccatcgatgctggggctgcatcttccggctgtgtcgtcgacagcgtcgatgcccaaggagcgcctgtcgtgaggcgaagtgagcgcggtggagcaagtctaagcgtcgaggtgctcatgtgggcgccgatcgcgctggtgatcatcgggtttgttgtgggtatcggccggatgtcgatggcccaggacgcggtgagtggcgcggcgggtgctgcggcccgtgcggcgtcgttggagcgtgatggacagtcggctcagtctgcggcgcagcaggcggcgtcggcgaacctgtcgtccggtgggctggcatgtgcgccgagtgtgagcgtggacacgtcagtgtttgcccgtcctgccgggcaggcgggcacggttcacgccacggtcacgtgtgtcacctcgctgggtcttgggttcgggtcccggacggtgcacgcaacggggtctgccccggtagacacctatcgggaaaggagaggctgagatggcccgcgatgagcgtggtggcggctcggtgtcggtgtggatgctgctcatggtgccggtgattctggtcatggccggcctggtttttgacgggtcccgtcagatatcggcaacccaggcggcccaggacgcggcggttgcggcatcccgcgccggaactgatgcggcagcgacaccgcagcttgctggccacgacggggcggccgtagcagtccaagcggcccgccaggcactatctgctgccggggtggacgggtcggtgcaggaggacgggtcgaccatcacggtgaccacgtctcaaagtcggccgacagtgttcctgtcagcgatcggaatcagccaggtaagggggcatgggcaggcccatgctcagcttgtgggaccgggagaacgcccatgacagtgatacgtcgtatcggtgccctggtggcactgctggtggtgatagccggcttaccggccgggctcgtggccgcaggcgccccgctagtaccctcgggcctgtcatgggcccatgtgcggcatctgttggttaccccagacatgaccgggtcggtgctggtgtggctggtcagcctcatcggctggatcgggtgggcatggttcgccctggccgtcgcagccgaagcggtgacgatgctctcagggcagcggctgcactggcacatgcccggccctcgcctagtgcgccgagtggcagccggtcttctcattgccgcgttcgcggccgcaccggcagccacaagcacggctcacgccgccgaggccacccatgtggcggtcgccgcccaggctggaccggcacacgcggcccccgcccaggacagccccgccaccacctctcaggccccggacgcctccaccactccgaaaatctggaagacctacacggtgcgggccaacgactacctgtggaagatcgccgagcactactacggtga

SEQ ID NO: 249 - DNA, 4892 bp, Propionibacterium acnes
gataccgcaaggctgtgtgggatcagctgttcgggatggggcggttgcagccgctgttcgaaatcagcgacgccgaaaacatcatcgtggtgggtaaccatgaggtggttgtcgaccacaacgatggttcccggtcaacgctgccgccggtggccgactcggatgccgagctggaatcccagatcgcccggatggcgaggaatgcgaccccgcggcgagccttcgacgccgatcacaccgatgtgacgatcatgcaccaacagaagttccgtatccacgcgatctcagcggaagtgtcattgcaaccgtcggtggtcatccgccaacatttgctcacccaaatcagtctgggggacctgtcacatcgcggaatgatgccggtggaagtggcccggttcctcgatgaggcggtacaagctggcaagtccatcgtggtcgccggcgagcagggggcaggcaagacgacgtttttacgagcgttgatccacgccattccgatgcgggagcggttcgccacgttggagaccgatcaggagttgttcgctcatctgatgcctggccgggaaaacacgctggtgctgttcgcccgtgatggtaacggcgaggtggatccggcgactggcacccagcacggcgctatcgagatcgcccagctgattcctcctagcctgcgccaggcgttaactagggtcattgtcggtgaggtgcgcggcaatgaggcctcggccatgttccaggccatgcagtcgggtacaggcaccatgagcagtatccactccccgcgagcctctgaggtgccgtcccggctagcccaaatgatttcgatgggcccggtctacgatctggatcaggccatgctgcagatcggtcattcgatcgactacatcgtctttgttcgtaagcgtgacctgcctgatgggagccggctgcgatttgttgagcagatccgttcagtctcgcctggtgattcgacaactcccagtcttggcgaggtgtacacggctgactcgtggacaggccagccgcttacgccactcatgcctggttcggccgccgacgagctgtctcacttcgcccgagacctggattactgcgaggcccactcatgaacactcccgcactaaccagcgccctcatcgtgaccgggctagggctgatcctggccatcgacgggctggtcccggcgccgcctcgacctggtgccccgctgagcccggcccaaaggtgggctcggctcacccaccgtcccactggtgcggccgggcgtcgccgggatttgcgttgggggttggctgttcttgtcggtgtcgtgctgtttgtgctcaccgggtgggtggctgcgctggcgctgggccccatcattgtgttgttggcccccaccctgctgggggcggccccaccgaccgatattccgctgatggaggcgctggatcgctgggtgcgtcaggtcgctgcggtgctgccacaggggcgcgacatcatcacagcggtgcggatctcacggccgcgggccccgaagctgatcgccgggtcggtggatcaactggtgtcccggttggatggccgtatggagccgagggaggcgttccagcggatggccgacgagctggactcggctgaggctgacgcggtgctggcctcactagcgttggcggccactcatccgcggggagcctcgacaacgttgaaggctattgctggcaacatccaacagcggttgaaagtgctgcggcaggtggaggctgaacggtctaagccgcgtaactcggtgcgccagatcacactggtcacgatcgccatgttcggggggctgctcgtgatcggacggtcgtttctggccccgctggcgacccctcccggtcaggtgctggtggccgtggcggtggtcatgtatgtcatcgcactagtgcagatgtatcggatggcgcggccccgtcgacgcacccggatcatggtcaggaggacccgatgaccattactgctttgtccctgctagccggggccatcgtcactgtcggactgctggtcatcgtggcagcgttccgcccagccccaggccctgacctggttgccgctctggaggtggtgtcgggtcgcacctcaagcgtcgccgagaacgtcgaccagacccggatcgggcggataggtcgcagcgtgacccgcacattccatgtgtcggtgtccccggccatgcgggccgcactgcgactccaaggcacgacccccgaagcgttctacggtcgacgcctgatctgcgcactgatcggggcgatcctgccgtggctgctcaacgcggtagccatcgcggtaggggcgaattccccgaacctactcatcccttcggcgctgtgtgtggcgttagctggcgctggatggatgctgccggcagcacggttgaaggctgcggccgggcccaccaacgatgactcgttcgaagcgctgctggtattcatcgatttggtcgtgctggaacggctcgccaacgaaacctccgtcgacgcgctcaccaatgcggcaaacatgtcggactcgccgctattcgtccagatccgtcaagtcctcaaccgtgcctccctggaaaacgtcgacccgtggaacgggctagaccggctagccgaggacatcaaactgcccgaactcaccgatgtggtctccatcgcccgcctccaaaacgaaggcgcctccctcgtcgacagtttccgggcccgagtcgccgagttacgcgacgcctacctgctgcgcctgcaacaagaatccaccgccatcacccagcggcttggtttgtggacgatcctgcaagccggctcggtcatgctcatcttgctgggggcggccgccctcacactcatcacagccggataaaacgacaccgtgtcgagcccccatatgggccgcgaacctttcataatgatgcctgtaagcaccacaatattgatcacaacctaacaatgaaggagaaatcatgatgaccgatctcgacctggctaaaaaacagatcacctggctggcggcgcacctgcgttcccggatcgttgacgagcgtggcggtggtagctctaccgtggagacactgatttggattggtgtcatcgtggcgctggtgattggtgtgggcgtcggggtgacggcctatatcaggtcgaagatgcctcactgacgacgatgcgtagcaggttcacaactgatcagcgtggcggtggtagcgcgtcggtggggatgctcctgctgatgcctgcgatcatgctgctggcattcggtgggatcgaggtcgggatgtggtgtcacgcccatcagtcgaccatcgcggcagcccaaagcgccgcggaggctcagcgtgtcgtccatccggtcccggggtcggcacaggaggcagcctcgcagatcactagtcatggcggggtgcgtgatgcgcggatatcggtcagtgatgacggggccactgtcacggtgaccgtctcaggtcgggccccatcgatgctggggctgcatcttccggctgtgtcgtcgacagcgtcgatgcccaaggagcgcctgtcgtgaggcgaagtgagcgcggtggagcaagtctaagcgtcgaggtgctcatgtgggcgccgatcgcgctggtgatcatcgggtttgttgtgggtatcggccggatgtcgatggcccaggacgcggtgagtggcgcggcgggtgctgcggcccgtgcggcgtcgttggagcgtgatggacagtcggctcagtctgcggcgcagcaggcggcgtcggcgaacctgtcgtccggtgggctggcatgtgcgccgagtgtgagcgtggacacgtcagtgtttgcccgtcctgccgggcaggcgggcacggttcacgccacggtcacgtgtgtcacctcgctgggtcttgggttcgggtcccggacggtgcacgcaacggggtctgccccggtagacacctatcgggaaaggagaggctgagatggcccgcgatgagcgtggtggcggctcggtgtcggtgtggatgctgctcatggtgccggtgattctggtcatggccggcctggtttttgacgggtcccgtcagatatcggcaacccaggcggcccaggacgcggcggttgcggcatcccgcgccggaactgatgcggcagcgacaccgcagcttgctggccacgacggggcggccgtagcagtccaagcggcccgccaggcactatctgctgccggggtggacgggtcggtgcaggaggacgggtcgaccatcacggtgaccacgtctcaaagtcggccgacagtgttcctgtcagcgatcggaatcagccaggtaagggggcatgggcaggcccatgctcagcttgtgggaccgggagaacgcccatgacagtgatacgtcgtatcggtgccctggtggcactgctggtggtgatagccggcttaccggccgggctcgtggccgcaggcgccccgctagtaccctcgggcctgtcatgggcccatgtgcggcatctgttggttaccccagacatgaccgggtcggtgctggtgtggctggtcagcctcatcggctggatcgggtgggcatggttcgccctggccgtcgcagccgaagcggtgacgatgctctcagggcagcggctgcactggcacatgcccggccctcgcctagtgcgccgagtggcagccggtcttctcattgccgcgttcgcggccgcaccggcagccacaagcacggctcacgccgccgaggccacccatgtggcggtcgccgcccaggctggaccggcacacgcggcccccgcccaggacagccccgccaccacctctcaggccccggacgcctccaccactccgaaaatctggaagacctacacggtgcgggccaacgactacctgtggaagatcgccgagcactactacggt

SEQ ID NO: 250 - DNA, 4617 bp, Propionibacterium acnes
gcgataccgcaaggctgtgtgggatcagctgtgccgctcccccgacatggcagacagcaccgttgcatgagaactgactgacactgtggcgccgcggaggtctcccgcggcgtccgctggggcgagtgcatgcctgtcagctcatcttttatcgtcatgtttccccttgtcagagcggtctttgcaaagtgacaacgtcaggggtcttgacgacaacatcctcgacaacatcgtggcggtggtctgtgtctcgtcagttcaacgcaccggggaaagaggcaccgctgatgttcaccaccacaaacaccctcaacgatgaatgggaccagattcgcgccactgagatcgattggcatgactgccctgaactgatgcactgcatcgacgttgatgatgtgttggccgtcattcctgccgcccccgacgccatcttgggctacctcattgcccgggctcagggcggtgacgagttggccacccgcactatcatccaagcgttcacaggcaagcttattttgatggccacggccaccaaggtgcgccgtactaatgacggcttcaatgatctgttggcgggtctgtgggagacgatcatcacgtacccgttagatcgtcgccctgacaagatcgctgcgaacctcatcctcgacacgttgcaccgggttacccggttttggcgtgctgattcccccgatgaggaagaggctcacggtctggtgcccttccctgacactctcatcgccccagagcccgatgaggacgtcacagctagccaggccatcgccttggcggtggaccgcaactggattaccgaggacctagcccgcctcatgagccatatttactgtgacggtatgactggagctgatgcgggtcgtctgcatggctgcgctccagctacggtgcgatctcgatgccgtgatggtcgggccgtgttgcagcgcaacgccgagacgatcctggccgtctgctgatccctctcttgctcatgcctgccgccaccctacccctacctgctagaaacatagccatgtctccagcaacgcatctagcgtatcttctagcaattgatctagctatcatatagctgatgatctagctatcatatagctgtgtctccagcccaaaggacagcccaatggcatgcttgccacaggaaggtgcgtcagcctcccgaaatactggaaggagctttaccgtgcaggacatgacctcgaccagaccgattgaccgatccccgttcgaccgcactattgcggtgtggaaccacaaaggcggcacgttcaagacgtccgtcgtggcgaacctgggatacctgttcgccgccggtggcaacaaggtgttgatggtcgacatggacccccaggccaatctcgacattgacttcggtatacccgcgggagaacgtgaacggggcatgggattagccgaggcgctacgtgaggggacggcccttcccccaccgcagcatctcagcgaaaaccttcacctggtcagtggcggcccggccctccacgagttcaccgaccccgcatccttagcggccatcctcgaccgagtcaccaccgcacgctacgacctgctagctcaggcccttgccccgctggcctgggactatgacctcatcttcatcgactccgggccggcccaaactctgctgtcccagaccatccttggagtagcccgctggctggtagtgcccacccgcaccgataacgcctcaatcactggcctcgtcgacgttcaagacgccatcgacggggttgcctcctgcaaccctgaccttcaactactcggcgttgtcctagccggcgtgggggcccgggccacccggatcgccgcagataaacgccacgccatcgacacagtgctgggggcaggaaccgttttcgatgcggtcatccactactccgagaaggtgtccgtgctcgcacgccagcagggcaagaccgtcgccgagctagccaacgactaccacaacacccagcccgcctacacctacctagctaaaggccagaacatccccaacgtcgccaaggcagccgtcagcatcgaaactgattatctgaggctggccaccgagatcagcgaccgcatgttcaccagcgacgagcaggagcctgatcatgactgacgatccgactccatccgagcagaacaaccccaccagcgacgacatgcgcttggccgaagaatgggccaacagcggccgcacagtgggagccctgccgcgccgtcaacggcctcagcgacccacaccccgcaccaccagccaaccccctgtctcgtcccctgacacaccggctccgaaaaaaccccagaagacccccaccagccagcctggccgtcaacggatcaacgtcaccgtctacgttgtgcccgaactccatgagcggctgcgctcccgatcggcggcgacgggggtgacggtctcggatctggtggtgcatgcgttagcgttcgtcgccgatcatgcgggggaggcgatcgccgatgatctgcgcgtcgagacgggccccggcatgggggccggactgttcgatgtgaccccatcgcggccagtaggggtcgccaaaacccagctgggggtgcgaatgacccgccacaacaaggatggtttggaccagctgacccggacgagtggagcccgtgaccgcagccatcttgtgtctgtcgccgtgcgcgactatctcgactccaaccctgtaaagaaaggccgacatgtccgctgatgaaactcctgccgcccggggtgggcgacgctttgatacgaccgtcaagcccaggcgccgtcccatgcttatcgccgccggtatcgccatcgtgatagtcggcgcgctcctcatcactcagttgattcgctccgcccaaaccgagcatcgcgtgctggaagtccacgccgatgtggctcgcggcgaggtcatccgtgacaccgatctggtatcggtgactgtcggccaggtcgacaacgtatcaacggttcccgcagaccagctcgactcactggtcggcaaacgcgccacggcagatcttcgagccggatcactcttacctgctggggctatcggcccggccgatgtcgttccagctccgggcaagtcgctggtcgggctgaagctagccgccggacagatccctatcggagaccttgctgccgggacgaagctgcgcctgatccagacgtcggcacccagcggctcatccaccaccactgatagcagcaccaataccgatggccagtcgtgggaggcaacaatggcgaccggcaccaaaaagaccgagcaggtcaccttgatcaacgccgaagtgaactcgcgtgatgccgcccggatcgcccaactgacgtcacagggccgtatcgccgtagtgaaggatccgatccgatgagcaccattgttttgaccagcgtctcgggagccccaggggtcaccacgacagcgatcgggctgggcagggtctggccacaatcgagcctggtcgtcgaggatgacacccaccacgccatgctggcgggctacctgcgagcctcccagcacgccgaaccgaacctggccgcagtggcgaacctgacgtcgactccaaccaacgcccaaacggtgtgggaatctatcgccagacccctacccaccgatgacccagtcggcgggctgcgacgcaaaggcatcctcggcccgcccacgccgtggtctcgcgcaggcatcgacccccgatggggattcatgctggccctgtggcggcaactggaggaggctggcatcgacaccatcatcgatttgggtcgcctagccacaccactgacctcaacgccacacctgatcgccgcacccatcgtcgaggacgccgacatgatcttggtgatgatcgaggcgacactacgcgacatcgccggcgcccgcacgatggtggagggactcgctgagcagatgaacttggccggcgcctaccgacgtctcggactgcttgtccaccgtggcggccaggcccgcggcgtcgccgagttcaatgacaaggagatcacctcggcgttacgactcccggtcatcggggccattacccatgacccggccggagccgcccaactctccgacggggtcgggcagcggttcgacaagtcacgtctggcccactcactatcaaaggtggcggccagcctcgtcgatgccataaacaagcgccacgctgatgacgaggaggatctgtgatggccagttttgctgataatccgttcgacaagctgcgctcccaggatgcggcaagagcttcggtagagcaggagcctgatgccggattagcgtcggagttgttttcgacgtcgtcggggtgggccagctctcagcaggtgtcccaagctcaaccggtgatgacccgttcggagaacgtggattggtcggttgtcgcggagctagccagtacggccactgatgaggttgaggctgagatcagccggtggagttccactcatgatggggtggcgacgctagacattcgccaggccatcgcggagcctgctattgcctcggcggtgtctacgtatgctgaccgacgccagatcgatgtaggggagacctggcctgatctggtacgccagcgataccgcaaggctgtgtgggatcagct

SEQ ID NO: 251 - DNA, 4613 bp, Propionibacterium acnes
gataccgcaaggctgtgtgggatcagctgtgccgctcccccgacatggcagacagcaccgttgcatgagaactgactgacactgtggcgccgcggaggtctcccgcggcgtccgctggggcgagtgcatgcctgtcagctcatcttttatcgtcatgtttccccttgtcagagcggtctttgcaaagtgacaacgtcaggggtcttgacgacaacatcctcgacaacatcgtggcggtggtctgtgtctcgtcagttcaacgcaccggggaaagaggcaccgctgatgttcaccaccacaaacaccctcaacgatgaatgggaccagattcgcgccactgagatcgattggcatgactgccctgaactgatgcactgcatcgacgttgatgatgtgttggccgtcattcctgccgcccccgacgccatcttgggctacctcattgcccgggctcagggcggtgacgagttggccacccgcactatcatccaagcgttcacaggcaagcttattttgatggccacggccaccaaggtgcgccgtactaatgacggcttcaatgatctgttggcgggtctgtgggagacgatcatcacgtacccgttagatcgtcgccctgacaagatcgctgcgaacctcatcctcgacacgttgcaccgggttacccggttttggcgtgctgattcccccgatgaggaagaggctcacggtctggtgcccttccctgacactctcatcgccccagagcccgatgaggacgtcacagctagccaggccatcgccttggcggtggaccgcaactggattaccgaggacctagcccgcctcatgagccatatttactgtgacggtatgactggagctgatgcgggtcgtctgcatggctgcgctccagctacggtgcgatctcgatgccgtgatggtcgggccgtgttgcagcgcaacgccgagacgatcctggccgtctgctgatccctctcttgctcatgcctgccgccaccctacccctacctgctagaaacatagccatgtctccagcaacgcatctagcatatcttctagcaattgatctagctatcatatagctgatgatctagctatcatatagctgtgtctccagcccaaaggacagcccaatggcatgcttgccacaggaaggtgcgtcagcctcccgaaatactggaaggagctttaccgtgcaggacatgacctcgaccagaccgattgaccgatccccgttcgaccgcactattgcggtgtggaaccacaaaggcggcacgttcaagacgtccgtcgtggcgaacctgggatacctgttcgccgccggtggcaacaaggtgttgatggtcgacatggacccccaggccaatctcgacattgacttcggtatacccgcgggagaacgtgaacggggcatgggattagccgaggcgctacgtgaggggacggcccttcccccaccgcagcatctcagcgaaaaccttcacctggtcagtggcggcccggccctccacgagttcaccgaccccgcatccttagcggccatcctcgaccgagtcaccaccgcacgctacgacctgctagctcaggcccttgccccgctggcctgggactatgacctcatcttcatcgactccgggccggcccaaactctgctgtcccagaccatccttggagtagcccgctggctggtagtgcccacccgcaccgataacgcctcaatcactggcctcgtcgacgttcaagacgccatcgacggggttgcctcctgcaaccctgaccttcaactactcggcgttgtcctagccggcgtgggggcccgggccacccggatcgccgcagataaacgccacgccatcgacacagtgctgggggcaggaaccgttttcgatgcggtcatccactactccgagaaggtgtccgtgctcgcacgccagcagggcaagaccgtcgccgagctagccaacgactaccacaacacccagcccgcctacacctacctagctaaaggccagaacatccccaacgtcgccaaggcagccgtcagcatcgaaactgattatctgaggctggccaccgagatcagcgaccgcatgttcaccagcgacgagcaggagcctgatcatgactgacgatccgactccatccgagcagaacaaccccaccagcgacgacatgcgcttggccgaagaatgggccaacagcggccgcacagtgggagccctgccgcgccgtcaacggcctcagcgacccacaccccgcaccaccagccaaccccctgtctcgtcccctgacacaccggctccgaaaaaaccccagaagacccccaccagccagcctggccgtcaacggatcaacgtcaccgtctacgttgtgcccgaactccatgagcggctgcgctcccgatcggcggcgacgggggtgacggtctcggatctggtggtgcatgcgttagcgttcgtcgccgatcatgcgggggaggcgatcgccgatgatctgcgcgtcgagacgggccccggcatgggggccggactgttcgatgtgaccccatcgcggccagtaggggtcgccaaaacccagctgggggtgcgaatgacccgccacaacaaggatggtttggaccagctgacccggacgagtggagcccgtgaccgcagccatcttgtgtctgtcgccgtgcgcgactatctcgactccaaccctgtaaagaaaggccgacatgtccgctgatgaaactcctgccgcccggggtgggcgacgctttgatacgaccgtcaagcccaggcgccgtcccatgcttatcgccgccggtatcgccatcgtgatagtcggcgcgctcctcatcactcagttgattcgctccgcccaaaccgagcatcgcgtgctggaagtccacgccgatgtggctcgcggcgaggtcatccgtgacaccgatctggtatcggtgactgtcggccaggtcgacaacgtatcaacggttcccgcagaccagctcgactcactggtcggcaaacgcgccacggcagatcttcgagccggatcactcttacctgctggggctatcggcccggccgatgtcgttccagctccgggcaagtcgctggtcgggctgaagctagccgccggacagatccctatcggagaccttgctgccgggacgaagctgcgcctgatccagacgtcggcacccagcggctcatccaccaccactgatagcagcaccaataccgatggccagtcgtgggaggcaacaatggcgaccggcaccaaaaagaccgagcaggtcaccttgatcaacgccgaagtgaactcgcgtgatgccgcccggatcgcccaactgacgtcacagggccgtatcgccgtagtgaaggatccgatccgatgagcaccattgttttgaccagcgtctcgggagccccaggggtcaccacgacagcgatcgggctgggcagggtctggccacaatcgagcctggtcgtcgaggatgacacccaccacgccatgctggcgggctacctgcgagcctcccagcacgccgaaccgaacctggccgcagtggcgaacctgacgtcgactccaaccaacgcccaaacggtgtgggaatctatcgccagacccctacccaccgatgacccagtcggcgggctgcgacgcaaaggcatcctcggcccgcccacgccgtggtctcgcgcaggcatcgacccccgatggggattcatgctggccctgtggcggcaactggaggaggctggcatcgacaccatcatcgatttgggtcgcctagccacaccactgacctcaacgccacacctgatcgccgcacccatcgtcgaggacgccgacatgatcttggtgatgatcgaggcgacactacgcgacatcgccggcgcccgcacgatggtggagggactcgctgagcagatgaacttggccggcgcctaccgacgtctcggactgcttgtccaccgtggcggccaggcccgcggcgtcgccgagttcaatgacaaggagatcacctcggcgttacgactcccggtcatcggggccattacccatgacccggccggagccgcccaactctccgacggggtcgggcagcggttcgacaagtcacgtctggcccactcactatcaaaggtggcggccagcctcgtcgatgccataaacaagcgccacgctgatgacgaggaggatctgtgatggccagttttgctgataatccgttcgacaagctgcgctcccaggatgcggcaagagcttcggtagagcaggagcctgatgccggattagcgtcggagttgttttcgacgtcgtcggggtgggccagctctcagcaggtgtcccaagctcaaccggtgatgacccgttcggagaacgtggattggccggttgtcgcggagctagccagtacggccactgatgaggttgaggctgagatcagccggtggagttccactcatgatggggtggcgacgctagacattcgccaggccatcgcggagcctgctattgcctcggcggtgtctacgtatgctgaccgacgccagatcgatgtaggggagacctggcctgatctggtacgccagcgataccgcaaggctgtgtgggatcag

SEQ ID NO: 252 - DNA, 5053 bp, Propionibacterium acnes
tggtgggcgctggaccaggtttgcggggcatgcgcgcatcggtgatcttggccgccaccaggtgttccagattgtccaagtgcccggagtcagaggtcagcagaagagtagtcacctcgaccgcggtggctgaggcgatctgagctgtgcggcggtcgtgatgggtggtgtcagtgctgacagctgtggtgggagcggatgccggggccgccgaacggaccagggcaacggggccgcatgcgactccgcacagcacgagggcaaggaagcctttggtggccatcgatccggtgtggggccagggacccacgttttcctgtgcctgttttttcttggccgaccaacggcgggacttagggttagcggatgcaccttctggggtgcatgctcgtctcaatcgcatcggtcacctccttcactggatgaagggaccaaggaggtgaccgatgtgcggtcgaacccgaaaaagttcaaacttttttctgggtctgcctcaagtacgacagaaggcctgcatcatcacggcgttgtggtagcagatcttgcgtcagcgcaaatgtatgggcctcgtaggagtagctcttaggtgggtcccggtggttgcggccagggcgagggtgtcgggtatgtgtagcgctagtcccgggttcgtggtgtgagggcttttgggtgctgacatgcactacccattgctagacgctgtgctgtggcatggctggacgtctagcagacgggttgacatcacctttaggctggcagcgcccgaggccgcaggccagaggaagcggacagcctaacgattgacgtccccctctcctttccccaacctcctggagtcgatgacccggagatagatcgatgtctatgcatctgtgcatcgatatacctatgtatctgtctgtggtttttagaggccactcccgtcgccccgggccgctcagcgataccgcaaggctgtgtgggatcagctgttccgctctcccgacatggcagacagcaccctgcggactgactgacactgtggcgccgcggaggtctcccgcggcgtccgctggggcgagtgcatgcctgtcagctcatcttttatcgtcatgtttccccttgtcagagcggtctttgcaaagtgacaacgtcaggggtcttgacgacaacatcctcgacaacatcgtggcggtggtctgtgtctcgtcagttcaacgcaccggggaaagaggcaccgctgatgttcaccaccacaaacaccctcaacgatgagtgggaccagattcgcgccactgagatcgattggcatgactgccctgaactgatgcactgcatcgacgttgatgatgtgttggccgtcattcctgccgcccccgacgccatcttgggctacctcattgcccgggctcagggcggtgacgagttggccacccgcactatcatccaagcgttcacaggcaagcttatcttgatggccacggccaccaaggtgcgccgtactaatgacggcttcaatgatctgttggcgggtctgtgggagacgatcatcacgtacccgttggatcgtcgccctgacaagatcgctgcgaacctcatcctcgacacgttgcaccgggttacccggttctggcgtgctgattcccccgatgaggaagaggctcacggtctggtgcccttccctgacactctcatcgccccagagcccgatgaggacgtcacagctagccaggccatcgccttggcggtggaccgcaactggattaccgaggacctagcccgcctcatgagccatatttactgtgacggtatgactggagctgatgcgggtcgtctgcatggctgcgctccagctacggtgcgatctcgatgccgtgatggtcgggccgtgttgcagcgcaacgccgagacgatcctggccgtctgctgatccctctcttgctcatgcctgccgccaccctacccctacctgctagaaacatagccatgtctccagcaacgcatctagcgtatcttctagcaattgatctagctatgtatatagctgatgatctagctaccatatagctgtgtctccagcccaaaggacagcccaatggcatgcttgccacaggaaggtgcgtcagcctcccgaaatactggaaggagctttaccgtgcaggacatgacctcgaccagaccgattgaccgatccccgttcgaccgcactattgcggtgtggaaccacaaaggcggcacgttcaagacgtccgtcgtggcgaacctgggatacctgttcgccgccggtggcaacaaggtgctgctggtcgacatggacccccaggccaatctcgacattgacttcggtatacccgcgggagaacgtgaacggggcatgggattagccgaggcgctacgtgaggggacggcccttcccccaccgcagcatctcagcgaaaaccttcacctggtcagtggcggcgctgctctcaacgagttcaccgaccccgcatccttagcggccatcctcgaccgagtcaccaccgcacgctacgacctgctagctcaggcccttgccccgctggcctgggactatgacctcatcttcatcgactccgggccggcacaaactctgctgtcccagaccatccttggagtagcccgctggctggtagtgcccacccgcaccgataacgcctcaatcactggcctcgtcgacgttcaagacgccatcgacggggttgcctcctgcaaccctgaccttcaactactcggcgttgtcctagccggcgtgggggcccgggccacccggatcgccgcagataaacgccacgccatcgacacagtgctgggggcaggaaccgttttcgatgcggtcatccactactccgagaaggtgtccgtgctcgcacgccagcagggcaagaccgtcgccgagctagccaacgagtaccacaacacccagcccgcctacacctacctagctaaaggccagaacatccccaacgtcgccaaggcagccgtcagcatcgaaactgattatctgaggctggccaccgagatcagcgaccgcatgttcaccagcgacgagcaggagcctgatcatgactgacgatccgactccatccgagcagaacaaccccaccagcgacgacatgcgcttggccgaagaatgggccaacagcggccgcacagtgggagccctgccgcgccgtcaacggcctcagcgacccacaccccgcaccaccagccaaccccctgtctcgtcccctgacacaccggctccgaaaaaaccccagaagacccccaccagccagcctggccgtcaacggatcaacgtcaccgtctacgttgtgcccgaactccatgagcggctgcgctcccgatcggcggcgacgggggtgacggtctcggatctggtggtgcatgcgttagcgttcgtcgccgatcatgcgggggaggcgatcgccgatgatctgcgcgtcgagacgggccccggcatgggggccggactgttcgatgtgaccccatcgcggccagtaggggtcgccaaaacccagctgggggtgcgaatgacccgccacaacaaggatggtttggaccagctgacccggacgagtggagcccgtgaccgcagccatcttgtgtctgtcgccgtgcgcgactatctcgactccaaccctgtaaagaaaggccgacatgtccgctgatgaaactcctgccgcccggggtgggcgacgctttgatacgaccgtcaagcccaggcgccgtcccatgcttatcgccgccggtatcgccatcgtgatagtcggcgcgctcctcatcactcagttgattcgctccgcccaaaccgagcatcgcgtgctggaagtccacgccgatgtggctcgcggcgaggtcatccgtgacaccgatctggtatcggtgactgtcggccaggtcgacaacgtatcaacggttcccgcagaccagctcgactcactggtcggcaaacgcgccacggcagatcttcgagccggatcactcttgcctgctggggctatcggcccggccgatgtcgttccagctccgggcaagtcgctggtcgggctgaagctagccgccggacagatccctatcggagaccttgctgccgggacgaagctgcgcctgatccagacctcggcaggcgggtcatccaccaccgggcagggcgccaccaataccgatattcaatcgtgggctgcgacgatggcgtccggcaccaaaagtactgagcaggtcaccttgatcaatgtggaggtggactcgcgtgatgcagctcggatcgcccagctgacatcgcagggccgtatcgctgtggtaaaggattcgactcgatgagcacaatcgttttgaccagtgtgtcgggagccccgggggtgaccacgacagcgattgggttggggcgggtctggccacagtccagtctggttgtcgaggacgacacccatcacgcgatgttggcgggctatctgcgagctgcccagcacgccgagccgaacttggccacggtggcaaatctgacggccactccgaccaatgcccaaaccgtgtgggaatccatcgccaggcctctgcccaccgatgatccggtcagcgggctgagacgcaaggccgtcctcggcccgcccacaccgtggtctcgtgcaggtatcgacccccggtggggattcatgctggccctgtggcggcagctggccgaggccgggatcgacaccatcatcgacctgggtcgcctagccacgccgctgacgtcaacgccacatctgatcgccacacccatcgtcgaggacgccgacatgatcctggtgatgatcgaggcgacgctacgcgatgtggccggcgcccacacgatggtcgaagggctggccgagcagatgaacctggccggggcccaccagcgcctcggactgttggtccaccgcggcggcgcggcccgcggggtcgctgagttcaccgacaaagagatcacgtcggcgttgcagctaccggtctgcgggtcgatagtccatgacccagtcgcggcagcccagctgtctgacggggtcgggcagcggttcgacaagtcgcgtct

SEQ ID NO: 253 - DNA, 4892 bp, Propionibacterium acnes
gataccgcaaggctgtgtgggatcagctgttcgggatggggcggttgcagccgctgttcgaaatcagcgacgccgaaaacatcatcgtggtgggtaaccatgaggtggttgtcgaccacaacgatggttcccggtcaacgctgccgccggtggccgactcggatgccgagctggaatcccagatcgcccggatggcgaggaatgcgaccccgcggcgagccttcgacaccgatcacaccgatgtgacgatcatgcaccaacagaagttccgtatccacgcgatctcagcggaagtgtcattgcaaccgtcggtggtcatccgccaacatttgctcacccaaatcagtctgggggacctgtcacatcgcggaatgatgccggtggaagtggcccggttcctcgatgaggcggtacaagctggcaagtccatcgtggtcgccggcgagcagggggcaggcaagacgacgtttttacgagcgttgatccacgccattccgatgcgggagcggttcgccacgttggagaccgatcaggagttgttcgctcatctgatgcctggccgggaaaacacgctggtgctgttcgcccgtgatggtaacggcgaggtggatccggcgactggcacccagcacggcgctatcgagatcgcccagctgattcctcctagcctgcgccaggcgttaactagggtcattgtcggtgaggtgcgcggcaatgaggcctcggccatgttccaggccatgcagtcgggtacaggcaccatgagcagtatccactccccgcgagcctctgaggtgccgtcccggctagcccaaatgatttcgatgggcccggtctacgatctggatcaggccatgctgcagatcggtcattcgatcgactacatcgtctttgttcgtaagcgtgacctgcctgatgggagccggctgcgatttgttgagcagatccgttcagtctcgcctggtgattcgacaactcccagtcttggcgaggtgtacacggctgactcgtggacaggccagccgcttacgccactcatgcctggttcggccgccgacgagctgtctcacttcgcccgagacctggattactgcgaggcccactcatgaacactcccgcactaaccagcgccctcatcgtgaccgggctagggctgatcctggccatcgacgggctggtcccggcgccgcctcgacctggtgccccgctgagcccggcccaaaggtgggctcggctcacccaccgtcccactggtgcggccgggcgtcgccgggatttgcgttgggggttggctgttcttgtcggtgtcgtgctgtttgtgctcaccgggtgggtggctgcgctggcgctgggccccatcattgtgttgttggcccccaccctgctgggggcggccccaccgaccgatattccgctgatggaggcgctggatcggtgggtgcgtcaggtcgctgcggtactgccacaggggcgagacatcatcacagcggtgcggatctcacggccgcgggccccgaagctgatcgccgggtcggtggatcaactggtgtcccggttggatggccgtatggagccgagggaggcgttccagcggatggccgacgagctggactcggctgaggctgacgcggtgctggcctcactagcgttggcggccactcatccgcggggagcctcgacaacgttgaaggctattgctggcaacatccaacagcggttgaaagtgctgcggcaggtggaggctgaacggtctaagccgcgtaactcggtgcgccagatcacactggtcacgatcgccatgttcggggggctgctcgtgatcggacggtcgtttctggccccgctggcgacccctcccggtcaggtgctggtggccgtggcggtggtcatgtatgtcatcgcactagtgcagatgtatcggatggcgcggccccgtcgacgcacccggatcatggtcaggaggacccgatgaccattactgctttgtccctgctagccggggccatcgtcactgtcggactgctggtcatcgtggcagcgttccgcccagccccaggccctgacctggttgccgctctggaggtggtgtcgggtcgcacctcaagcgtcgccgagaacgtcgaccagacccggatcgggcggataggtcgcagcgtgacccgcacattccatgtgtcggtgtccccggccatgcgggccgcactgcgactccaaggcacgacccccgaagcgttctacggtcgacgcctgatctgcgcactgatcggggcgatcctgccgtggctgctcaacgcggtagccatcgcggtaggggcgaattccccgaacctactcatcccttcggcgctgtgtgtggcgttagctggcgctggatggatgctgccggcagcacggttgaaggctgcggccgggcccaccaacgatgactcgttcgaagcgctgctggtattcatcgatttggtcgtgctggaacggctcgccaacgaaacctccgtcgacgcgctcaccaatgcggcaaacatgtcggactcgccgctattcgtccagatccgtcaagtcctcaaccgtgcctccctggaaaacgtcgacccgtggaacgggctagaccggctagccgaggacatcaaactgcccgaactcaccgatgtggtctccatcgcccgcctccaaaacgaaggcgcctccctcgtcgacagtttccgggcccgagtcgccgagttacgcgacgcctacctgctgcgcctgcaacaagaatccaccgccatcacccagcggcttggtttgtggacgatcctgcaagccggctcggtcatgctcatcttgctgggggcggccgccctcacactcatcacagccggataaaccgacaccgtgtcgagcccccatatgggccgcgaacctttcataatgatgcctgtaagcaccacaatattgatcacaacctaacaatgaaggagaaatcatgatgaccgatctcgacctggctaaaaaacagatcacctggctggcggcgcacctgcgttcccggatcgttgacgagcgtggcggtggtagctctaccgtggagacactgatttggattggtgtcatcgtggcgctggtgattggtgtgggcgtcggggtgacggcctatatcaggtcgaagatgcctcactgacgacgatgcgtagcaggttcacaactgatcagcgtggcggtggtagcgcgtcggtggggatgctcctgctgatgcctgcgatcatgctgctggcattcggtgggatcgaggtcgggatgtggtgtcacgcccatcagtcgaccatcgcggcagcccaaagcgccgcggaagctcagcgtgtcgtccatccggtcccggggtcggcacaggaggcagcctcgcagatcactagtcatggcggggtgcgtgatacccggatatcggtcagtgatgacggggccactgtcacggtgaccgtctcaggtcgggccccatcgatgctggggctgcatcttccggctgtgtcgtcgacagcgtcgatgcccaaggagcgcctgtcgtgaggcgaagtgagcgcggcggagcaagtctaagcgtcgaggtgctcatgtgggcgccgatcgcgctggtgatcatcgggtttgttgtgggtatcggccggatgtcgatggcccaggacgcggtgagtggcgcggctggtgctgcggcccgtgcggcgtcgttggagcgtgatggacagtcggctcagtctgcggcgcagcaggcggcgtcggcgaacctgtcgtccggtgggctggcatgtgcgccgagtgtgagcgtggacacgtcagtgtttgcccgtcctgccgggcaggcgggcacggttcacgccacggtcacgtgtgtcacctcgctgggtcttggattcgggtcccggacggtgcacgcaacggggtctgccccggtagacacctatcgggaaaggagaggctgagatggcccgcgatgagcgtggtggcggctcggtgtcggtgtggatgctgctcatggtgccggtgattctggtcatggccggcctggtttttgacgggtcccgtcagatatcggcaacccaggcggcccaggacgcggcggttgcggcatcccgcgccggaactgatgcggcagcgacaccgcagcttgctggccacgacggggcggccgtagcagtccaagcggcccgccaggcactatctgctgccggggtggacgggtcggtgcaggaggacgggtcgaccatcacggtgaccacgtctcaaagtcggccgacagtgttcctgtcagcgatcggaatcagccaggtaagggggcatgggcaggcccatgctcagcttgtgggaccgggagaacgcccatgacagtgatacgtcgtatcggtgccctggtggcactgctggtggtgatagccggcttaccggccgggctcgtggccgcaggcgccccgctagtaccctcgggcctgtcatgggcccatgtgcggcatctgttggttaccccagacatgaccgggtcggtgctggtgtggctggtcagcctcatcggctggatcgggtgggcatggttcgccctggccgtcgcagccgaagcggtgacgatgctctcagggcagcggctgcactggcacatgcccggcccccgcttggcgcgccgagtggcagccggtctcctcattgccgcgttcgcgggcgcaccggcggccacgtcggcagctcacgcggtcgaggccacccatgtggcggtcgcagctcaggcttccccggcccacgcggccggcacccaggacagccccgccaccacctctcaggccccggacgcctccaccactccgaaaatctggaagacctacacggtgcgggccaacgactacctgtggaagatcgccgagcactactacggt

SEQ ID NO: 254 - DNA, 4611 bp, Propionibacterium acnes
gcgataccgcaaggctgtgtgggatcagctgtgccgctcccccggcatgacaggcggcgccccacagattgacgacactgcggggctgcggaggtctcccgcggcgtccgctggggcgagtgcatgcctgtcagctcatcttttatcgtcatgtttccccttgtcagagcggtttttgcaaagtgacaacgtcaggggtcttgacgacaacatcctcgacaacatcgtggcggtggtctgtgtcttgtcagttcaacgcaccggggaaagaggcaccgctgatgttcaccaccacagctaccctcaacgatgaatgggaccagattcgcgccatcgagatcgattggcatgactgccccgaactgatgcactgcatcgacgttgatgatgtgttggccgtcattcctgccgcccccgacgccatcttgggctacctcattgcccgggctcagggcggtgacgagttggccacccgcactatcatccaagcgttcacaggcaagcttattttgatggccacggccaccaaggtgcgccgtactaatgacggcttcaatgatctgttggcggggttgtgggagacgatcatcacgtacccgttggatcgtcgccctgacaagatcgctgcgaacctcaccctcgacacgttgcaccgggttacccggttctggcgtgctgattcccccgatgaggaagaggctcacggtctggtgcccttccctgacactctcatcgccccagagcccgatgaggacgtcacagctagccaggccatcgccttggcggtggaccgcaactggattaccgaggacctagcccgcctcatgagccatatttactgtgacggtatgactggagctgatgcgggtcgtctgcatggctgcgctccagctacggtgcgatctcgatgccgtgatggtcgggccgtgttgcagcgcaacgccgagacgatcctggccgtctgctgatcctctcttgctcatgcctgccgccaccctacccctacctgctagaaacatagccatgtctccagcaacgcatctagcatatcttctagcaattgatctagctatgtatatagctgatgatctagctatcatatagctgtgtctccagcgcaaatgacagcccaatagcatgcttgccacaggaaggtgcgtcagcctcccgaaatactggaaggagctttaccgtgcaggacatgacctcgaccagaccgattgaccgatccccgttcgaccgcactattgcggtgtggaaccacaagggcggcacgttcaagacgtccgtcgtggcgaacctgggatacctgttcgccgccggtggcaacaaggtgctgctggtcgacatggacccccaagccaatctcgacattgacttcggtatacccgcgggagaacgtgaacggggcatgggattagccgaggcgctacgtgaggggacggcccttcccccaccgcagcatctcagcgagaaccttcacctggtcagtggcggcgctgctctcaacgagttcaccgaccccgcatccttagcggccatcctcgagcgggtcaccaccgagcgctacgacctgctagctcaggcccttgccccgctggcctgggactatgacctcatcttcatcgactccgggcctgcccaaactctgctgtcccagaccatccttggagtagcccgctggctggtagtgcccacccgcaccgataacgcctcaatcactggcctcgtcgacgttcaagacgccatcgacggggttgcctcctgtaaccctgaccttcaactactcggcgttgtcctagccggcgtgggggcccgggccacccggatcgccgcagataaacgccacgccatcgacacagtgctgggggcaggaaccgttttcgatgcggtcatccactactccgagaaggtgtccgtgctcgcacgccagcagggcaagaccgtcgccgagctagccaacgagtaccacaacacccagcccgcctacacctacctagctaaaggccagaacatccccaacgtcgccaaggcagccgtcagcatcgaaactgattatctgaggctggccaccgagatcagcgaccgcatgttcaccagcgacgagcaggagcctgatcatgactgacgatccgactccatccgagcagaacaaccccaccagcgacgacatgcgcttggccgaagaatgggccaacagcggccgcacagtgggagccctgccgcgccgtcaacggcctcagcgacccacaccccgcaccaccagccaaccccctgtctcgtcccctgacacaccggctccgaaaaaagcccagaagacccccaccagccagcctggccgtcaacggatcaacgtcaccgtctacgttgtgcccgaactccatgagcggctgcgctcccgatcggcggcgacgggagtgacggtctcggatctggtggtgcatgcgttagcgttcgtcgccgatcatgcgggggaggcgatcgccgatgatctgcgcgtcgagacgggccccggcatgggggccggactgttcgatgtgaccccatcgcggccagtaggggtcgccaaaacccagctgggggtgcgaatgacccgccacaacaaggatggtttggaccagctgacccggacgagtggagcccgtgaccgcagccatcttgtgtctgtcgccgtgcgcgactatctcgactccaaccctgtaaagaaaggccgacatgtccgctgatgaaactcctgccgcccggggtgggcgacgctttgatacgaccgtcaagcccaggcgccgtcccatgcttatcgccgccggtatcgccatcgtgatagtcggcgcgctcctcatcactcagttgattcgctccgcccaaaccgagcatcgcgtgctggaagtccacgccgatgtggctcgcggcgaggtcatccgtgacaccgatctggtatcggtgactgtcggccaggtcgacaacgtatcaacggttcccgcagaccagctcgactcactggtcggcaaacgcgccacggcagatcttcgagccggatcactcttgcctgctggggctatcggcccggccgatgtcgttccagctccgggcaagtcgctggtcgggctgaagctagccgccggacagatccctatcggagaccttgctgccgggacgaagctgcgcctgatccagacgtcggcacccagcggctcatccaccaccactgatagcagcaccaataccgatggccagtcgtgggaggcaacaatggcgaccggcaccaaaaagaccgagcaggtcaccttgatcaacgccgaagtgaactcgcgtgatgccgcccggatcgcccaactgacgtcacagggccgtatcgccgtagtgaaggatccgatccgatgagcaccattgttttgaccagcgtctcgggagccccaggggtcaccacgacagcgatcgggctgggcagggtctggccacaatcgagcctggtcgtcgaggatgacacccaccacgccatgctggcgggctacctgcgagcctcccagcacgccgaaccgaacctggccgcagtggcgaacctgacgtcgactccaaccaacgcccaaacggtgtgggaatctatcgccagacccctacccaccgatgacccagtcggcgggctgcgacgcaaaggcatcctcggcccgcccacgccgtggtctcgcgcaggcatcgacccccgatggggattcatgctggccctgtggcggcaactggaggaggctggcatcgacaccatcatcgatttgggtcgcctagccacaccactgacctcaacgccacacctgatcgccgcacccatcgtcgaggacgccgacatgatcttggtgatgatcgaggcgacactacgcgacatcgccggcgcccgcacgatggtggagggactcgctgagcagatgaacttggccggcgcccaccgacgtctcggactgcttgtccaccgtggcggccaggcccgcggcgtcgccgagttcaatgacaaggagatcacctcggcgttacgactcccggtcatcggggccattacccatgacccggccggagccgcccaactctccgacggggtcgggcagcggttcgacaagtcacgtctggcccactcactatcaaaggtggcggccagcctcgtcgatgccataaacaagcgccacgctgatgacgaggaggatctgtgacggccagttttgctgataatccgttcgacaagctgcgctcccaggatgcggcaagagcttcggtagagcaggagcctgatgccggattagcgtcggagttgttttcggcgtcgtcggggtgggccagctctcagcaggtgtcccaagctcaaccggtgatgacccgttcggagaacgtggattggccggttgtcgcggagctagccagtacggccactgatgaggttgaggctgagatcagccggtggagttccactcatgatggggtggcgacgctagacattcgccaggccatcgcggagcctgctattgcctcggcggtgtctacgtatgctgaccgacgccagatcgatgtaggggagacctggcctgatctggtacgccagcgataccgcaaggctgtgtgggatcagct

SEQ ID NO: 255 - DNA, 4345 bp, Propionibacterium acnes
ccggacagatccctatcggagaccttgctgtcgggacgaagctgcgcctgatccagacgtcggcacccagcggctcatccaccaccactgatagcagcaccaataccgatggccagtcgtgggaggcaacaatggcgaccggcaccaaaaagaccgagcaggtcaccttgatcaacgccgaagtgaactcgcgtgatgccgcccggatcgcccaactgacgtcacagggccgtatcgccgtagtgaaggatccgatccgatgagcaccattgttttgaccagcgtctcgggagccccaggggtcaccacgacagcgatcgggctgggcagggtctggccacaatcgagcctggtcgtcgaggatgacacccaccacgccatgctggcgggctacctgcgagcctcccagcacgccgaaccgaacctggccgcagtggcgaacctgacgtcgactccaaccaacgcccaaacggtgtgggaatctatcgccagacccctacccaccgatgacccagtcggcgggctgcgacgcaaaggcatcctcggcccgcccacgccgtggtctcgcgcaggcatcgacccccgatggggattcatgctggccctgtggcggcaactggaggaggctggcatcgacaccatcatcgatttgggtcgcctagccacaccactgacctcaacgccacacctgatcgccgcacccatcgtcgaggacgccgacatgatcttggtgatgatcgaggcgacactacgcgacatcgccggcgcccgcacgatggtggagggactcgctgagcagatgaacttggccggcgcctaccgacgtctcggactgcttgtccaccgtggcggccaggcccgcggcgtcgccgagttcaatgacaaggagatcacctcggcgttacgactcccggtcatcggggccattacccacgacccggccggagccgcccaactctccgacggggtcgggcagcggttcgacaagtcacgtctggcccactcactatcaaaggtggcggccagcctcgtcgatgccataaacaagcgccacgctgatgacgaggaggatctgtgatggccagttttgctgataatccgttcgacaagctgcgctcccaggatgcggcaagagcttcggtagagcaggagcctgatgccggattagcgtcggagttgttttcgacgtcgtcggggtgggccagctctcagcaggtgtcccaagctcaaccggtgatgacccgttcggagaacgtggattggccggttgtcgcggagctagccagtacggccactgatgaggttgaggctgagatcagcaggtggagttccactcatgatggggtggcgacgctagacattcgccaggccatcgcggagcctgctattgcctcggcggtgtctacgtatgctgaccgacgccagatcgatgtaggggagacctggcctgatctggtacgccagcgataccgcaaggctgtgtgggatcagctgttcgggatggggcggttgcagccgctgttcgaaatcagcgacgccgaaaacatcatcgtggtgggtaaccatgaggtggttgtcgaccacaacgatggttcccggtcaacgctgccgccggtggccgactcggatgccgagctggaatcccagatcgcccggatggcgaggaatgcgaccccgcggcgagccttcgacgccgatcacaccgatgtgacgatcatgcaccaacagaagttccgtatccacgcgatctcttcggaggtgtcgttgcaaccgtcggtggtcatccgccaacatttgctcacccaaatcagtctgggggacctgtcccagcggggaatgatgccggtggaagtggcccggttcctcgatgaggcggtacaagctggcaagtccatcgtggtcgccggcgagcagggggcaggcaagacgacgtttttacgagcgttgatccacgccattccgatgcgggagcggttcgccacgttggagaccgatcaggagttgttcgctcatctgatgcctggccgggaaaacacgctggtgctgttcgcccgtgatggtaacggcgaggtggatccggcgactggcacccagcacggcgctatcgagatcgcccagctgattcctcctagcctgcgccaggcgttaactagggtcattgtcggtgaggtgcgcggcaatgaggcttcggccatgttccaggctatgcagtcggggactggcactatgagcagtatccactccccgcgagcctctgaggtgccgtcccggctagcccaaatgatttcgatgggcccggtctacgatctggatcaggccatgctgcagatcggtcattcgatcgactacatcgtctttgttcgtaagcgtgacctgcctgatgggagccggctgcgatttgttgagcagatccgttcagtctcgcctggtgattcgacaactcccagtcttggcgaggtgtacacggctgactcgtggacaggccagccgcttacgccactcatgcctggttcggccgccgacgagctgtctcacttcgcccgagacctggattactgcgaggcccactgatgaacaccccagcgctgatagcagccctcatcgtgaccggcctgggactgatcatggccatcaacggcctgatcccggccacacccaaacccggcaccacgctgacgctgtcacagcggtgggcccgggccacccaccgcccagccggggcagccgggcgccgacgcgacctgcgctgggcgctggccggtctcgtcggcatcgtgctgttcgtcctcacaggttgggtcgctgccctggccctgggccccatcaccgtgctgctagcacccaccctgctgggggcggccccaccgaccgatattccgctgatggaggcgttggatcggtgggtgcgtcaggtcgctgcggtgctgccacaggggcgagacatcatcacagcggtgcggatctcacggccgcgggccccgaagctgatcgccgggtcggtggatcaactggtgtcccggttggatggccgtatggagccgagggaggcgttccagcggatggccgacgagctggactcggctgaggctgacgcggtgctggcctcactagcgttggcggccactcatccgcggggagcctcgacaacgttgaaggctattgctggcaacatccaacagcggttgaaagtgctgcggcaggtggaggctgagcggtctaagccgcgtaactcggtgcgccagatcacactggtcacgatcgccatgttcggggggctgctcgtgatcggacggtcgtttctggccccgctggcgacccctcccggtcaggtgctggtggccgtggcggtggtcatgtatgtcatcgcactagtgcagatgtatcggatggcgcggccccgtcgacgcacccggatcatggtcaggaggacccgatgaccattactgctttgtccctgctggccggggccatcgtcactgtcggactgctggtcatcgtggcagcgttccgcccagccccaggccctgacctggttgccgctctggaggtggtgtcgggtcgcacctcaagcgtcgccgagaacgtcgaccagacccggatcgggcggataggtcgcagcgtgacccgcacattccatgtgtcggtgtccccggccatgcgggccgcactgcgactccaaggcacgacccccgaagcgttctacggtcgacgcctgatctgcgcactgatcggggcgatcctgccgtggctgctcaacgcggtagccatcgcggtaggggcgaattccccgaacctactcatcccttcggcgctgtgtgtggcgttagctggcgctggatggatgctgccggcagcacggttgaaggctgcggccgggcccaccaacgatgactcgttcgaagcgctgctggtattcatcgatttggtcgtgctggaacggctcgccaacgaaacctccgtcgacgcgctcaccaatgcggcaaacatgtcggactcgccgctattcgtccagatccgtcaagtcctcaaccgtgcctccctggaaaacgtcgacccgtggaacgggctagaccggctagccgaggacatcaaactgcccgaactcaccgatgtggtctccatcgcccgcctccaaaacgaaggcgcctccctcgtcgacagtttccgggcccgagtcgccgagttgcgcgacgcctacctgctgcgcctgcaacaagaatccaccgccatcacccagcggcttggtttgtggacgatcctgcaagccggctcggtcatgctcatcttgctgggggcggccgccctcacactcatcacagccggataaaccgacatcgtgtcgagc

SEQ ID NO: 256 - DNA, 4249 bp, Propionibacterium acnes
gacgccggccaccccaactactccgacccacacggtgaccccagctccggcctctgccggccactcgaccagcgacgagcacccactccatacggataccgccgcagcggacaaggccagcaacgaggacgccctgtccccaatccaggtgggtttgaccgccagcgtcggactggtgctggtcgccggactgatcaccaccctcaaccgccgctaccggacccggttcacccgccagccccgcggcaaggccatgaccctgcccagcccggacgcccaaactgccgagatagcgctgcgcagcaccggggcgactgacactctgacgatcacctgcctcgaccaggcgctccgcgcgatcggcgcatggtgccaccactgcgggcacccgctgccacccctgctggccgcccgcgtcgatgacgaccggatcgacctgctgctatcccaggcggcccccgaccatcccgaggcggtggagctggccgccgacggatcggtgtggaccctcaccgccgaccggatcgacgacctgctagcccacaccgatgacaaccaagcggctccgtggccgtctctggtcacactgggacgcgacgacgacggcgcccacatcctcatcgacttggaagccgcaggaaccttgcacctgatcgccgatgacgaccaggtcgacgcggccctcgccgcgatcgccgtggaactggccacctgcgactggtccgacgaagtcaacgtcaccctcgtcggccaggtgtgcccgggcctagaagacgcactagagtctccgaccctgacccgcgccaccgacgtggacaccctcctcaccaccctagaagctcgcgccgacgaccagcgacacatcctcaccgaaggaaaccccctcgccgctcaccgagccgaccccgccatctccgacgggttcgacgccgaagtgatcctcctcgacaccgaactcaccgaagaccaccgcaaccgcctcgccagcctcgtcgaggctcttccccgcgtgtcagtcgccgcggtaacaaccagccccaccagctcagacgaatggtccctcaccctgacaggtgacccactagccgccgacctggctcccctcggctggcacatccacccccaaaccctctcccccgacctgtacaaccgcatggttgaactactcgccaactccgccgccgcagactacgaacccgccagctggtggaaccacgacgccgacgacgagcccaccaccgaccccaccaacgaggaagaatctaccccgagcaggcgagcccgcccgaatatccgcctgaccaccctgaccggcggcatcgacctatccagcgtcgacatcgacgacatcatcgacgaagccaaccaggccctcgacaacaccgaccagaccaccaaccaggttcgcgtcgacaccaaccaacccggcaccgacacccccttccccatcgacgacatcgacccgctgagctccgaccatccggtcctatccatcatcggccaccccgacatcacaggtgccactggaaccgttgggcgctccccgtggcgctgccaacagttggctctctacatcgctgagcatccgggagcatcgggggcgactatcgccgatgatttggggctatcagcgtcgacggtgcgctcgattgctacacacctgcgacactggttgggagccgacgatgccggggtggcttacatgccggcggcgacgcgcggctaccggctcgatgagcggatcgtcacagatgtggacctgatcgacgctgctgtggccggggcaggcattaacaccgctgagacggccacactggtggccattttgaagctgggccgcggacgggtcttcgctggggttcctgactcggaacttcgccagttcagggcgtcgatgtaccacgtggaggcccgcatcgtcgatgctgccctccaagtgacagaccgggccctggaagccggggacctggggctggcccggtgggcgttgacccaagggctactggtgtctcccgatcatgaggacctggtcaccggttgtctgcgcaccgagtaccaggccggcaacatggacaaggtttccgagctggtcgatcacctgtcggctaccgcacgacgcctgggcgtcgatttgagcgccgacaccacccggatcatcgactccgttattacccatacacgcaggagagcatcatgatctcccgttgcactcatctccgtcaggaaggttcctatgcaccattatcgtcttggtatcggcactgccctcatcgcggtagcagccgtggccggctgtcgctcaacagactcgacacccacaccacctccatcccgtgtctccgccacgacatcagcgagctctaccctcagcccgaccccgtcagccggagcgatcagtgccgccgacgccgaaaacatctaccgcaccgtccaagctaacaagatcgcactgtacaaaaagggtggcctggcacccggggaacccgcacccgcgacactgtcgaactacgccaccggccaggctctcaccgactacatgacctacatgcaccaaatctcggggcagggcatcaaaatcacatcggggaactcctcggttaccgcggtgcgggagaaaaagggtgataccacctaccccgaagccgctatcgccttggaatcgtgcgaagacgacagttcgattcgtaccgtggaccgccacggaaaggctgatcatggacgcattttccatgtcgacagttggtatgcccgcgataagaagggcaccgtcaagatgatcgcattcaactcaacggaggtccccacatgcgacgtcaagtaatcaccgcggccgtactgggcctggccctggccaccacctccctgcccgccctcgcaggcggcggcgacttgaacggcagtgtggacacggatggccctggttacgatgtgcgtactgaggtggattaccatcacaccaccggtggtgcgggtgggggtgccacgacagggggccatcatgggggcaaaacccacggtgatggtgaaggtgaggctattgatgggcgttctcgcgccgatgccgaagccgaactagacgaagccgaccgtaaccaggacttgacttgtgatgtcttgctcccaccggcgccgaataccccagccggccaggaatgggcgaaagaatgcaatcccccagcgaaaaaggggcagaaggccaccccgaagcccgatccggtgttagtgggccgtcacgcggccttgcagctcacccttcccggcgcggcccctcgtatcgatccgtcccccgaccttaaccggtggcactcggcagcagtgggccaggctttgtggttgtcggttgatgaccccaccgccactacgcagaaatcgatcacgtttatgggccaggttgtctcgttgagcgccaaacgtaacggtttgtcgtttgatatgggtgatggtcatgtcgtgcactgtgatgccacgacgacatggacggagtcggtggaaccggggaccccctcacccacgtgcggttacacctaccaacaggcagccccggccgggggctataaggtcaccgcaatcacgtcgtgggatgtgacctggtcggtactaggacacacgggcacagtccacatccagaaggccggtgggcagatgcttccggtcggcgagttggagtctgttgttacacggcgatgactcctgatagtccgacgctgtatgaggtgttggaggtctgccctgatgccactgatgaccagatcaagacggcgtggcgtcgtgccgcgaaagtgactcaccctgatgccggtggcactagtgaggcgttcgcggccgcccggcacgcctgggaggtgttgtctgatcctgcccggcgcaccgcctacgatgccgacctggcgggggaggatgatcccgacgacgaagccgccgacgccttcgacgttgatccgttcacggcatggccctggtgcgccccgtacatcgacgccacccccaccctgcgccacacctgccccggcacgatcaaggccatcgtggtcgccatcgccgggatcatggccggaatcggctggcaggaagcgctggaggccgtggtgtcgccgccggggtttctgggggcgtgctggatagtctcagtgccggttgtcgtcgcagtgacatggctggcagcggtgacgggtctggcatttttcaccatggcggccatctggtgtggatggtcgttgataggtggtgcgttgctgtggggccagacgtc

SEQ ID NO: 257 - DNA, 1918 bp, Propionibacterium acnes
aaccgtcatctggcgtggagtagcgagctgatgcaggaaggcaatttgtacggccttcccgaggaagacccgttgtggggcgaggccgtggagctggtagcgggacttatcccctctgtgcgggcgatgtggtcgcacgatgggcagaccgtgactgtgtcggctggccggcgggtggcgacactggggatgccgatgcggggatggcgtggtatcgagatgcgcggctggaatccagtgggcgccgatacgtggtggatcgttgaccaggtgggtagttggctggtcgatcaggatgagccgatggtcgttgacgggagggtgctccatgaggcgtgggaacggtcgcagatggtccgttcaggccgctgagaaaaaatttaggtccgccctgcatatcggggcctcttcataccttcaaaagtgtgaagggaatacagactcttcgactggaattaaaatggtatatggcgtgtccggtccgcacccagctccacgatgcgccataggggagccataacttcaccaatcgtatacgatatgagtgtaggtgagcatctaccggtggccgacagtcagatacaagcatgggcggatgaagcagaagctgattatgacctcagcatgcttccgccgtctcgacgtggtcgcccaccggtggggaggggcccgggcactgtggtccctgtgcgcttcgacgcggacactctcaaggcgttgtcacaacgagcccctgacgaaggattgaccacgcgttctgacgcgatccgtgctgcggttaaccagtggctcggcctcggctcgtaaacattatcggcgcgacaaccttactgatgacgctgttggttacgccgtagagcacatcttgtactcgtgggcgctcgacgatgctgatgatcctcgttgctggatgatgattcggtgttgacccagctggcctcctcatggagctagttatcctcatctacgacgatggctatgaactcctgatccacgccatgaaagcccgccctcagtatctgagctacttcgctatctagtgttgttgggcgagttgaactcaacttttctccgacgcaagcgccaataaaaggctgatccatccgaataccaccaaacacggctgacgtgtggaacagattcagcaagacagggtgcggtgctcgggtgcgttggggagatgaggatattcaggcttctggcgggatgtggcttgatgacgtccaggatcaccggttcggttttgaaggtgccttgcattaatgtcgacagggtcgtacgactcgaggactggatcgaccagcccgttgcgtctgaagaacttcatccaccccggtggagctccggccgcgtactggtgcaacggatcattagcatgggtagcgtgagtatgccttcgatcgtggtcagtgctgtcatcatccaaggttctgacgggcggcttctcactgtccgtaaacgaggcaccgaggcattcatgctgccaggcggcaagccggagcccggcgaggactcgcgtcaggcagtagtccgggaagtgcacgaagagctcggcgtcgcattgtcttccgacgacctgcgtcgggtgggagtgttcaccacgcgagcagcgaatgaggccggccatcaggtggtggcgacgattttcacccacaccccggttgcggtgagtgagccagctgctgagatcgagcagattcgttggctcgattggagtgtcgacgccctgcctgatgacctggccccgctgctggtcgaggcagtcatcccgtggctgcggcgccgtatccggtcggtcgctgtattcacgggtgcgaaggatggaaccgaccctcattatcgtgtcgaagcaaccgccttgggccggggtctcgcacacgccgggatcaccctggtttatggcggcgggaaggtcggg

SEQ ID NO: 258 - DNA, 4029 bp, Propionibacterium acnes
gacgatcatcacgtacccgttagatcgtcgccctgacaagatcgctgcgaacctcatcctcgacacgttgcaccgggttacccggttttggcgtgctgattcccccgatgaggaagaggctcacggtctggtgcccttccctgacactctcatcgccccagagcccgatgaggacgtcacagctagccaggccatcgccttggcggtggaccgcaactggattaccgaggacctagcccgcctcatgagccatatttactgtgacggtatgactggagctgatgcgggtcgtctgcatggctgcgctccagctacggtgcgatctcgatgccgtgatggtcgggccgtgttgcagcgcaacgccgagacgatcctggccgtctgctgatccctctcttgctcatgcctgccgccaccctacccctacctgctagaaacatagccatgtctccagcaacgcatctagcgtatcttctagcaattgatctagctatcatatagctgatgatctagctatcatatagctgtgtctccagcccaaaggacagcccaatggcatgcttgccacaggaaggtgcgtcagcctcccgaaatactggaaggagctttaccgtgcaggacatgacctcgaccagaccgattgaccgatccccgttcgaccgcactattgcggtgtggaaccacaaaggcggcacgttcaagacgtccgtcgtggcgaacctgggatacctgttcgccgccggtggcaacaaggtgttgatggtcgacatggacccccaggccaatctcgacattgacttcggtatacccgcgggagaacgtgaacggggcatgggattagccgaggcgctacgtgaggggacggcccttcccccaccgcagcatctcagcgaaaaccttcacctggtcagtggcggcccggccctccacgagttcaccgaccccgcatccttagcggccatcctcgaccgagtcaccaccgcacgctacgacctgctagctcaggcccttgccccgctggcctgggactatgacctcatcttcatcgactccgggccggcccaaactctgctgtcccagaccatccttggagtagcccgctggctggtagtgcccacccgcaccgataacgcctcaatcactggcctcgtcgacgttcaagacgccatcgacggggttgcctcctgcaaccctgaccttcaactactcggcgttgtcctagccggcgtgggggcccgggccacccggatcgccgcagataaacgccacgccatcgacacagtgctgggggcaggaaccgttttcgatgcggtcatccactactccgagaaggtgtccgtgctcgcacgccagcagggcaagaccgtcgccgagctagccaacgactaccacaacacccagcccgcctacacctacctagctaaaggccagaacatccccaacgtcgccaaggcagccgtcagcatcgaaactgattatctgaggctggccaccgagatcagcgaccgcatgttcaccagcgacgagcaggagcctgatcatgactgacgatccgactccatccgagcagaacaaccccaccagcgacgacatgcgcttggccgaagaatgggccaacagcggccgcacagtgggagccctgccgcgccgtcaacggcctcagcgacccacaccccgcaccaccagccaaccccctgtctcgtcccctgacacaccggctccgaaaaaaccccagaagacccccaccagccagcctggccgtcaacggatcaacgtcaccgtctacgttgtgcccgaactccatgagcggctgcgctcccgatcggcggcgacgggggtgacggtctcggatctggtggtgcatgcgttagcgttcgtcgccgatcatgcgggggaggcgatcgccgatgatctgcgcgtcgagacgggccccggcatgggggccggactgttcgatgtgaccccatcgcggccagtaggggtcgccaaaacccagctgggggtgcgaatgacccgccacaacaaggatggtttggaccagctgacccggacgagtggagcccgtgaccgcagccatcttgtgtctgtcgccgtgcgcgactatctcgactccaaccctgtaaagaaaggccgacatgtccgctgatgaaactcctgccgcccggggtgggcgacgctttgatacgaccgtcaagcccaggcgccgtcccatgcttatcgccgccggtatcgccatcgtgatagtcggcgcgctcctcatcactcagttgattcgctccgcccaaaccgagcatcgcgtgctggaagtccacgccgatgtggctcgcggcgaggtcatccgtgacaccgatctggtatcggtgactgtcggccaggtcgacaacgtatcaacggttcccgcagaccagctcgactcactggtcggcaaacgcgccacggcagatcttcgagccggatcactcttacctgctggggctatcggcccggccgatgtcgttccagctccgggcaagtcgctggtcgggctgaagctagccgccggacagatccctatcggagaccttgctgccgggacgaagctgcgcctgatccagacgtcggcacccagcggctcatccaccaccactgatagcagcaccaataccgatggccagtcgtgggaggcaacaatggcgaccggcaccaaaaagaccgagcaggtcaccttgatcaacgccgaagtgaactcgcgtgatgccgcccggatcgcccaactgacgtcacagggccgtatcgccgtagtgaaggatccgatccgatgagcaccattgttttgaccagcgtctcgggagccccaggggtcaccacgacagcgatcgggctgggcagggtctggccacaatcgagcctggtcgtcgaggatgacacccaccacgccatgctggcgggctacctgcgagcctcccagcacgccgaaccgaacctggccgcagtggcgaacctgacgtcgactccaaccaacgcccaaacggtgtgggaatctatcgccagacccctacccaccgatgacccagtcggcgggctgcgacgcaaaggcatcctcggcccgcccacgccgtggtctcgcgcaggcatcgacccccgatggggattcatgctggccctgtggcggcaactggaggaggctggcatcgacaccatcatcgatttgggtcgcctagccacaccactgacctcaacgccacacctgatcgccgcacccatcgtcgaggacgccgacatgatcttggtgatgatcgaggcgacactacgcgacatcgccggcgcccgcacgatggtggagggactcgctgagcagatgaacttggccggcgcctaccgacgtctcggactgcttgtccaccgtggcggccaggcccgcggcgtcgccgagttcaatgacaaggagatcacctcggcgttacgactcccggtcatcggggccattacccatgacccggccggagccgcccaactctccgacggggtcgggcagcggttcgacaagtcacgtctggcccactcactatcaaaggtggcggccagcctcgtcgatgccataaacaagcgccacgctgatgacgaggaggatctgtgatggccagttttgctgataatccgttcgacaagctgcgctcccaggatgcggcaagagcttcggtagagcaggagcctgatgccggattagcgtcggagttgttttcgacgtcgtcggggtgggccagctctcagcaggtgtcccaagctcaaccggtgatgacccgttcggagaacgtggattggtcggttgtcgcggagctagccagtacggccactgatgaggttgaggctgagatcagccggtggagttccactcatgatggggtggcgacgctagacattcgccaggccatcgcggagcctgctattgcctcggcggtgtctacgtatgctgaccgacgccagatcgatgtaggggagacctggcctgatctggtacgccagcgataccgcaaggctgtgtgggatcag

SEQ ID NO: 259 - DNA, 4013 bp, Propionibacterium acnes
acccttccagcccagcaccacccactacaccgacacgatccacgaagctgaaaccgaacctcccatccccgtccgaaacatcaacgaactcatcaaccccaccaaccatgcatgaacgcacgatcgcctaccggccagccttcctgcgcgacgtgaagcggctcaaaaacaagcactacaacatgaacacacactcaaatgggcggtaaggtcacgaagtcgacgtggctgcctcacggatggcttcggcgagctcttggggtcgactccacatgggccagtggccggttggcagatccatcgcggtgaagttggtcaggtgcgcgacggcgctgaacatcggattgcctgctgcggccagctcgaggacctggacgctgggaatggagcagcagatcaacgtggttagtacatcatggcgagcgctattggacagcgcgacccgtgcccgggccacttgcgcgggttcaggaaccgcccgtgcccggaaccggtcaaggtgctcgttgctgaggccctctaaactggcctgcttgccgagagtatcgaagtcaggaagtggcagctcagctgtttcctcaggtagatctggtgcgaaggcacctccatcgctcatgggaccggagtccacccagacgatccgatggaccaactctgggtgcctgtctacaactaggctcaccggcccgttcgcgccactgtgtcccaccaggaccgcatcgccgcccatctcgtccaggatggctgagatggcgtcagcttggtcgtcgagcgtgcgcgtagtgcgctgggtgtcctccggatcgagacctggcagcgtcagccccacggctcgactgccagcagtgttcaataactcgactacctcgtcccaagcccaggctccgagccagtaaccaggaacgaggacgataggccgatgctggtcaggtcgcgatgttgaagtcatggagacatagttgcacagtgcgcggacaagggagtggcactatttctggcatgaatttagatctgggtgtccggtgaggcgatcagaacgcctccatgtactgtccgagtgtctaggatgcagcggacacagtcgagcagctggctcacaagtttccaggtgtccttctgcccctatgagggaagtcggctgctctcgcaacctttgagggctgctctggggtcggaaccagttacagatcgttcaagttccgggaactaccgccggtcacgctgattgattcccgggcgatctcgcttctgacgacagtggtcggtgaccgagaggagtcctactctgaccccgctgctgcggtgagtaaatcacgggcgtcccggatccggccacccgtccaagtgccagccagcttgatcggctaggcatcgtcaaggagcgacgatgaggtgatgatgcgatgtgagcgcaccgcgaagtgaggtataaagaagccttcccgggcgcatgcgtcgcccaggaaggccaggttggcccctggacggctgaatggttgggcggatcaggctgtagcggagacgtgcagtacctcgtaggcgatggcgttggttgggctctggtctgcatcgtggctactgagttcgacgaggatgacggtccaggtggtgatgtcgacggcggtgacgcgggcgatggtggaatcagtggatgctgcaaggaagtcggcggttatgtcttcgatgcagtgggacggagcagtgctggtgggcaggggcacggtcttgacggtcaggcttcgggcagcagagtaatcggcggttccgttaacaagctggtggacggtccagtcctggatcgggtgccggccgaagtcgcgtacgatagccgagtaaccaagttcgccccagcagaactggcgcatcccctctatgtcgcgccagacgtagaagggcgcgtaggagttctggggtgcgcctttgaccttttcttggatgaggtaggccttgaactccagtccatggtagccgtccatgaggtgtccagtctggatgacgcggtcgcggatgatctgcatgtcatagtcggtgggcagggtgatctgatattgcatggcgtacatcagcggttctccttggtttcgtgggagtaggtcgtgggggtgacgggttcctgccaatcgatggttgacaagtcgtcggcggcttgttggtaggtaaggtggatcattggctgtttgagtgcagcgccatgccagtgtctctggccggcgtcgatccagatggattcgcccttggtcaggtgctggggtgcttgtccttcaatatggaccagggcaacgccgcccgtgacgtagaggccctgtcccttggggtgtgtgtgcctcagcggcaaacgtgacggcgtgggcggcacgcccggcgtcttccgtggcacgatcggccggatccatggcggcgcgcagctgctgttctgcagccaggcgtccaggtcacggcgggcagcatcgacacccagggcagcctcgacggcttcagggctacgacgctggccgggctggttgaccgcagaccactggtgccgggcgtcgtccagatcatggccggcggcgtcgatgagggcggtggtggcttcggcgcagcatcgcctgatccactccgaacgtgacaggccagctgtctcggcggcactgtcaatgcgcgccaggagagatttcatgggcgctcatctgtagcctccagataggcgttgatgtagcgcagagcctgatccgtcatgtcgatggcggctgcctcggcagacgacacaacgggctgtggatgataagaccacccaacatagacggcgaacatcaatttctcgacagctttcatgaggtccccggcggcaaccgcatccgcctcatcatccgaggagaaccacttcaggtctgaacggctgtacatagcccctaggtcctgatgtgggtcgaggtccttggaatgatggaagttcctacacacccatcgccaaagacctcaacatggacaacgctaccttcaccactccctcatctgtgaagagccagtttatgcacggtgttgaaagaggcgtcggtctacgacgaatgcgggttaatggtcttgcggtgtggggcgctgggcgatggcatcgagaacgcgtgagtgggtggcgatccattcggccgcgtcggggttgatgttgcgggcgacggtgtcgatcgctgttacgtagtgggcaagcctgcgaatctcagcttgttggtcagggtgagcgctgatgaggggctcttgatgggaggcgcggttacggacgtggcggatgagctccacgttttcctcgaagtcgcgtcggctacgccccgggtagtgaggcatacctccgttacgtaagtcagtgagagctttccatacggttgcttccaggcgcggggtgagcagaaagcgccagttgtccagtgacagactcgccacgatctgatcaggggtcgcatcgagcctcgcgcgccgcagtcgcttctcggccctgtcgacgttacgcgggaaaccaccgagccgatagctcggggattcccaccaacgccgtatgccagtatcggcgctcaggcgcacgtcaatgaagtttctcaggagtacctcgacatggctgatgtcttccaagaacgctttcgagatgcgggtgttccacacgtaccacgcatcgactggttcgatccggtagcggctgagcctggcgggtgagaaccactcctgcaacgtctcacgactcaccgtgggagcgtggtaagattgatgacgataggcctcgggaaggtcaatgccgcgaaatatcggtatacccccgaggtcattgtcttgcccaggcccctcctcgcatacttgcggggcgtcattggctgccgtcatctcgtctcttcccggtacgtggctgtccatgttcacgggcaggtacggcaatgaggttcccgcacacaaacctctaccaaacatacgctggcaagccgttgcatgagacgacgcctccgcccgccacaccaacggtcaccgccacggccacggtgacggtgaccgtg

SEQ ID NO: 260 - DNA, 3969 bp, Propionibacterium acnes
gacgatcatcacgtacccgttagatcgtcgccctgacaagatcgctgcgaacctcatcctcgacacgttgcaccgggttacccggttttggcgtgctgattcccccgatgaggaagaggctcacggtctggtgcccttccctgacactctcatcgccccagagcccgatgaggacgtcacagctagccaggccatcgccttggcggtggaccgcaactggattaccgaggacctagcccgcctcatgagccatatttactgtgacggtatgactggagctgatgcgggtcgtctgcatggctgcgctccagctacggtgcgatctcgatgccgtgatggtcgggccgtgttgcagcgcaacgccgagacgatcctggccgtctgctgatccctctcttgctcatgcctgccgccaccctacccctacctgctagaaacatagccatgtctccagcaacgcatctagcatatcttctagcaattgatctagctaccatatagctgatgatctagctatcatatagctgtgtctccagcccaaaggacagcccaatggcatgcttgccacaggaaggtgcgtcagcctcccgaaatactggaaggagctttaccgtgcaggacatgacctcgaccagaccgattgaccgatccccgttcgaccgcactattgcggtgtggaaccacaaaggcggcacgttcaagacgtccgtcgtggcgaacctgggatacctgttcgccgccggtggcaacaaggtgttgatggtcgacatggacccccaggccaatctcgacattgacttcggtatacccgcgggagaacgtgaacggggcatgggattagccgaggcgctacgtgaggggacggcccttcccccaccgcagcatctcagcgaaaaccttcacctggtcagtggcggcccggccctccacgagttcaccgaccccgcatccttagcggccatcctcgaccgagtcaccaccgcacgctacgacctgctagctcaggcccttgccccgctggcctgggactatgacctcatcttcatcgactccgggccggcccaaactctgctgtcccagaccatccttggagtagcccgctggctggtagtgcccacccgcaccgataacgcctcaatcactggcctcgtcgacgttcaagacgccatcgacggggttgcctcctgcaaccctgaccttcaactactcggcgttgtcctagccggcgtgggggcccgggccacccggatcgccgcagataaacgccacgccatcgacacagtgctgggggcaggaaccgttttcgatgcggtcatccactactccgagaaggtgtccgtgctcgcacgccagcagggcaagaccgtcgccgagctagccaacgactaccacaacacccagcccgcctacacctacctagctaaaggccagaacatccccaacgtcgccaaggcagccgtcagcatcgaaactgattatctgaggctggccaccgagatcagcgaccgcatgttcaccagcgacgagcaggagcctgatcatgactgacgatccgactccatccgagcagaacaaccccaccagcgacgacatgcgcttggccgaagaatgggccaacagcggccgcacagtgggagccctgccgcgccgtcaacggcctcagcgacccacaccccgcaccaccagccaaccccctgtctcgtcccctgacacaccggctccgaaaaaaccccagaagacccccaccagccagcctggccgtcaacggatcaacgtcaccgtctacgttgtgcccgaactccatgagcggctgcgctcccgatcggcggcgacgggggtgacggtctcggatctggtggtgcatgcgttagcgttcgtcgccgatcatgcgggggaggcgatcgccgatgatctgcgcgtcgagacgggccccggcatgggggccggactgttcgatgtgaccccatcgcggccagtaggggtcgccaaaacccagctgggggtgcgaatgacccgccacaacaaggatggtttggaccagctgacccggacgagtggagcccgtgaccgcagccatcttgtgtctgtcgccgtgcgcgactatctcgactccaaccctgtaaagaaaggccgacatgtccgctgatgaaactcctgccgcccggggtgggcgacgctttgatacgaccgtcaagcccaggcgccgtcccatgcttatcgccgccggtatcgccatcgtgatagtcggcgcgctcctcatcactcagttgattcgctccgcccaaaccgagcatcgcgtgctggaagtccacgccgatgtggctcgcggcgaggtcatccgtgacaccgatctggtatcggtgactgtcggccaggtcgacaacgtatcaacggttcccgcagaccagctcgactcactggtcggcaaacgcgccacggcagatcttcgagccggatcactcttacctgctggggctatcggcccggccgatgtcgttccagctccgggcaagtcgctggtcgggctgaagctagccgccggacagatccctatcggagaccttgctgccgggacgaagctgcgcctgatccagacgtcggcacccagcggctcatccaccaccactgatagcagcaccaataccgatggccagtcgtgggaggcaacaatggcgaccggcaccaaaaagaccgagcaggtcaccttgatcaacgccgaagtgaactcgcgtgatgccgcccggatcgcccaactgacgtcacagggccgtatcgccgtagtgaaggatccgatccgatgagcaccattgttttgaccagcgtctcgggagccccaggggtcaccacgacagcgatcgggctgggcagggtctggccacaatcgagcctggtcgtcgaggatgacacccaccacgccatgctggcgggctacctgcgagcctcccagcacgccgaaccgaacctggccgcagtggcgaacctgacgtcgactccaaccaacgcccaaacggtgtgggaatctatcgccagacccctacccaccgatgacccagtcggcgggctgcgacgcaaaggcatcctcggcccggccacgccgtggtctcgcgcaggcatcgacccccgatggggattcatgctggccctgtggcggcaactggaggaggctggcatcgacaccatcatcgatttgggtcgcctagccacaccactgacctcaacgccacacctgatcgccgcacccatcgtcgaggacgccgacatgatcttggtgatgatcgaggcgacactacgcgacatcgccggcgcccgcacgatggtggagggactcgctgagcagatgaacttggccggcgcctaccgacgtctcggactgcttgtccaccgtggcggccaggcccgcggcgtcgccgagttcaatgacaaggagatcacctcggcgttacgactcccggtcatcggggccattacccatgacccggccggagccgcccaactctccgacggggtcgggcagcggttcgacaagtcacgtctggcccactcactatcaaaggtggcggccagcctcgtcgatgccataaacaagcgccacgctgatgacgaggaggatctgtgatggccagttttgctgataatccgttcgacaagctgcgctcccaggatgcggcaagagcttcggtagagcaggagcctgatgccggattagcgtcggagttgttttcgacgtcgtcggggtgggccagctctcagcaggtgtcccaagctcaaccggtgatgacccgttcggagaacgtggattggccggttgtcgcggagctagccagtacggccactgatgaggttgaggctgagatcagccggtggagttccactcatgatggggtggcgacgctagacattcgccaggccatcgcggagcctgctattgcctcggcggtgtctacgtatgctgaccgacgccagatcgat

SEQ ID NO: 261 - DNA, 4012 bp, Propionibacterium acnes
acccttccagcccagcaccacccactacaccgacacgatccacgaagctgaaaccgaacctcccatccccgtccgaaacatcaacgaactcatcaaccccaccaaccatgcatgaacgcacgatcgcctaccggccagccttcctgcgcgacgtgaagcggctcaaaaacaagcactacaacatgaacacacactcaaatgggcggtaaggtcacgaagtcgacgtggctgcctcacggatggcttcggcgagctcttggggtcgactccacatgggccagtggccggttggcagatccatcgcggtgaagttggtcaggtgcgcgacggcgctgaacatcggattgcctgctgcggccagctcgaggacctggacgctgggaatggagcagcagatcaacgtggttagtacatcatggcgagcgctattggacagcgcgacccgtgcccgggccacttgcgcgggttcaggaaccgcccgtgcccggaaccggtcaaggtgctcgttgctgaggccctctaaactggcctgcttgccgagagtatcgaagtcaggaagtggcagctcagctgtttcctcaggtagatctggtgcgaaggcacctccatcgctcatgggaccggagtccacccagacgatccgatggaccaactctgggtgcctgtctacaactaggctcaccggcccgttcgcgccactgtgtcccaccaggaccgcatcgccgcccatctcgtccaggatggctgagatggcgtcagcttggtcgtcgagcgtgcgcgtagtgcgctgggtgtcctccggatcgagacctggcagcgtcagccccacggctcgactgccagcagtgttcaataactcgactacctcgtcccaagcccaggctccgagccagtaaccaggaacgaggacgataggccgatgctggtcaggtcgcgatgttgaagtcatggagacatagttgcacagtgcgcggacaagggagtggcactatttctggcatgaatttagatctgggtgtccggtgaggcgatcagaacgcctccatgtactgtccgagtgtctaggatgcagcggacacagtcgagcagctggctcacaagtttccaggtgtccttctgcccctatgagggaagtcggctgctctcgcaacctttgagggctgctctggggtcggaaccagttacagatcgttcaagttccgggaactaccgccggtcacgctgattgattcccgggcgatctcgcttctgacgacagtggtcggtgaccgagaggagtcctactctgaccccgctgctgcggtgagtaaatcacgggcgtcccggatccggccacccgtccaagtgccagccagcttgatcggctaggcatcgtcaaggagcgacgatgaggtgatgatgcgatgtgagcgcaccgcgaagtgaggtataaagaagccttcccgggcgcatgcgtcgcccaggaaggccaggttggcccctggacggctgaatggttgggcggatcaggctgtagcggagacgtgcagtacctcgtaggcgatggcgttggttgggctctggtctgcatcgtggctactgagttcgacgaggatgacggtccaggtggtgatgtcgacggcggtgacgcgggcgatggtggaatcagtggatgctgcaaggaagtcggcggttatgtcttcgatgcagtgggacggagcagtgctggtgggcaggggcacggtcttgacggtcaggcttcgggcagcagagtaatcggcggttccgttaacaagctggtggacggtccagtcctggatcgggtgccggccgaagtcgcgtacgatagccgagtaaccaagttcgccccagcagaactggcgcatcccctctatgtcgcgccagacgtagaagggcgcgtaggagttctggggtgcgcctttgaccttttcttggatgaggtaggccttgaactccagtccatggtagccgtccatgaggtgtccagtctggatgacgcggtcgcggatgatctgcatgtcatagtcggtgggcagggtgatctgatattgcatggcgtacatcagcggttctccttggtttcgtgggagtaggtcgtgggggtgacgggttcctgccaatcgatggttgacaagtcgtcggcggcttgttggtaggtaaggtggatcattggctgtttgagtgcagcgccatgccagtgtctctggccggcgtcgatccagatggattcgcccttggtcaggtgctggggtgcttgtccttcaatatggaccagggcaacgccgcccgtgacgtagaggccctgtcccttggggtgtgtgtgcctcagcggcaaacgtgacggcgtgggcggcacgcccggcgtcttccgtggcacgatcggccggatccatggcggcgcgcagctgctgttctgcagccaggcgtccaggtcacggcgggcagcatcgacacccagggcagcctcgacggcttcagggctacgacgctggccgggctggttgaccgcagaccactggtgccgggcgtcgtccagatcatggccggcggcgtcgatgagggcggtggtggcttcggcgcagcatcgcctgatccactccgaacgtgacaggccagctgtctcggcggcactgtcatgcgcgccaggagagatttcatgggcgctcatctgtagcctccagataggcgttgatgtagcgcagagcctgatccgtcatgtcgatggcggctgcctcggcagacgacacaacgggctgtggatgataagaccacccaacatagacggcgaacatcaatttctcgacagctttcatgaggtccccggcggcaaccgcatccgcctcatcatccgaggagaaccacttcaggtctgaacggctgtacatagcccctaggtcctgatgtgggtcgaggtccttggaatgatggaagttcctacacacccatcgccaaagacctcaacatggacaacgctaccttcaccactccctcatctgtgaagagccagtttatgcacggtgttgaaagaggcgtcggtctacgacgaatgcgggttaatggtcttgcggtgtggggcgctgggcgatggcatcgagaacgcgtgagtgggtggcgatccattcggccgcgtcggggttgatgttgcgggcgacggtgtcgatcgctgttacgtagtgggcaagcctgcgaatctcagcttgttggtcagggtgagcgctgatgaggggctcttgatgggaggcgcggttacggacgtggcggatgagctccacgttttcctcgaagtcgcgtcggctacgccccgggtagtgaggcatacctccgttacgtaagtcagtgagagctttccatacggttgcttccaggcgcggggtgagcagaaagcgccagttgtccagtgacagactcgccacgatctgatcaggggtcgcatcgagccccgcgcgccgcagtcgcgcctcggccctggcgacgttacgcgggaaaccaccgagccgatagctcggggattcccaccaacgccgtatgccagtatcggcgctcaggcgcacgtcaatgaagtttctcaggagtacctcgacatggctgatgtcttccaagaacgctttcgagatgcaggtgttccacacgtaccacgcatcgactggttcgatccggtagcggctgagcctggcgggtgagaaccactcctgcaacgtctcacgactcaccgtgggagcgtggtaagattgatgacgataggcctcgggaaggtcaatgccgcgaaatatcggtatacccccgaggtcattgtcttgcccaggcccctcctcgcatacttgcggggcgtcattggctgccgtcatctcgtctcttcccggtacgtggctgtccatgttcacgggcaggtacggcaatgaggttcccgcacacaaacctctaccaagcatacgctggcaagccgttgcatgagacgacgcctccgcccgccacaccaacggtcaccgccacggccacggtgaccgtgaccgtg

SEQ ID NO: 262 - DNA, 811 bp, Propionibacterium acnes
attttgtccacccacccctgtcgattttgtccgccaagtattagacaaaccattagacagtgaattagaccctgggtcgcgtcagcgtgttagctcaccaacgcgcgcgcgcgcggcggccgagccgccgaagccaaagaaacccataccaccaacgcctgaaccagcagcccccgcttcagacagtcctgtgtcagcgcacgctgatgaggctgccgagttggcgtggcagttcgtggggtggtgtcctcagctggtaggggcaccgaagaaggtgcgtggccagctccgtcagctggtcgctgccgagatccgccggaatccgggctggctggatgcgccagcgttggaggttgttgcccagcgggtacgtgctgaaggtgcgctgggggtccagcactgcgagattgtgcgagccgagctgcacggggtgatcgccgaccagaaggccgcccccgcccgccccgacgccctgcacgcgcgggagcccaagtggtgggacgacgtgtactacgaaggaaacacaaccgtgtggacgtacgactctgacgaaaccagtgacgacgacgaggcgtggaaccggtcgcaggtatgtcatgttgctgagcgtgacgacatggctggcgggattgctaccaacctgctggcctcccacgctgatgatccgatggcctggctgactcgccgtcaaaccatgctgatggctcgtttcccccacgcccagaacgaggtcaccgcgatgtgccaaatcgtgcgcaccgccctggaggccgacctggccgccggaacccggtgggaggaccgatgaggg

SEQ ID NO: 263 - DNA, 3790 bp, Propionibacterium acnes
tagccgacacggcggaccgtgcccctgacagtaagcggcactactggagacatcaccatgaccgctcagatcctcgccccgtgcaaccagaaggctgccgtcatcgaaggagccctgccatgaaccaacctaccccccacaaggccgacgagtcacagacgagcaacaccacgaggaagtggcggcacaaggtgtcgttctaccaagacccggccgacaccgaccgagtccgcggagcgatcctccacaccatgacaaccgaaggcaaccggaacctgagccagttcgtcaacgatgccgtcatggccaaggtgaccgaactggaagcaaaatacaaccacggcgagccattccccgccgtgggagcccgaggactcccccagggcggcgcagccgccaacagataagagggcggggaccaccaatagcagtcgatttcggatccagatcgggtagacaggacccatgatgaatttcatatcctccctgctctcggccatcctgaccctctttgcgatggtagccgtggcgataggagtggtgaacattgtgccgggaatatgcgccatcatcggtgcacggaaatacggcgaccaggaccgtgtgcgggcaggacaacgaaagatccttcttggtgctatcgccttggtggtagcagtaggcattcacccgtgacccacggttaccggaagccccgccgcaatcgataccactgtcagtaccatcaggggcgataggggtcaagctctccttgtcacaatcccttccccggcagcccagtaaccgtcgcttacagccatacatggatatgcgcccattcgtcggcaccgacgccgtgcgggttggcgacgctgacccgtctgctcacaaacgacccttccagcccagcaccacccactacaccgacacgatccacgaagctgaaaccgaacctcccatccccgtccgaaacatcaacgaactcatcaaccccaccaaccatgcatgaacgcacgatcgcctaccggccagccttcctgcgcgacgtgaagcggctcaaaaacaagcactacaacatgaacacacactcaaatgggcggtaaggtcacgaagtcgacgtggctgcctcacggatggcttcggcgagctcttggggtcgactccacatgggccagtggccggttggcagatccatcgcggtgaagttggtcaggtgcgcgacggcgctgaacatcggattgcctgctgcggccagctcgaggacctggacgctgggaatggagcagcagatcaacgtggttagtacatcatggcgagcgctattggacagcgcgacccgtgcccgggccacttgcgcgggttcaggaaccgcccgtgcccggaaccggtcaaggtgctcgttgctgaggccctctaaactggcctgcttgccgagagtatcgaagtcaggaagtggcagctcagctgtttcctcaggtagatctggtgcgaaggcacctccatcgctcatgggaccggagtccacccagacgatccgatggaccaactctgggtgcctgtctacaactaggctcaccggcccgttcgcgccactgtgtcccaccaggaccgcatcgccgcccatctcgtccaggatggctgagatggcgtcagcttggtcgtcgagcgtgcgcgtagtgcgctgggtgtcctccggatcgaggccaggcagcgtcagccccacggctcgactgccagcagtgttcaataactcgactacctcgtcccaagcccaggctccgagccagtaaccaggaacgaggacgataggccgatgctggtcaggtcgcgatgttgaagtcatggagacatagttgcacagtgcgcggacaagggagtggcactatttctggcatgaatttagatctgggtgtccggtgaggcgatcagaacgcctccatgtactgtccgagtgtctacgatgcagcggacacagtcgagcagctggctcacaagtttccaggtgtccttctgcccctatgagggaagtcggctgctctcgcaacctttgagggctgctctggggtcggaaccagttacagatcgttcaagttccgggaactaccgccggtcacgctgattgattcccgggcgatctcgcttctgacgacagtggtcggtaaccgagaggcgtcctactctgaccccgctgctgcggtgagtaaatcacgggcgtcccggatccggccacccgtccaagtgccagccagcttgatcggctaggcatcgtcaaggagcgacgatgaggtgatgatgcgatgtgagcgcaccgcgaagtgaggtataaagaagccttcccgggcgcatgcgtcgcccaggaaggccaggttggcccctggacggctgaatggttgggcggatcaggctgtagcggagacgtgcagtacctcgtaggcgatggcgttggttgggctctggtctgcatcgtggctactgagttcgacgaggatgacggtccaggtggtgatgtcgacggcggtgacgcgggcgatggtggaatcagtggatgctgcaaggaagtcggcggttatgtcttcgatgcagtgggacggagcagtgctggtgggcaggggcacggtcttgacggtcaggcttcgggcagcagagtaatcggcggttccgttaacaagctggtggacggtccagtcctggatcgggtgccggccgaagtcgcgtacgatagccgagtaaccaagttcgccccagcagaactggcgcatcccctctatgtcgcgccagacgtagaagggcgcgtaggagttctggggtgcgcctttgaccttttcttggatgaggtaggccttgaactccagtccatggtagccgtccatgaggtgtccagtctggatgacgcagtcgcggatgatctgcatgtcatagtcggtgggcagggtgatctgatattgcatggcgtacatcagcggttctccttggtttcgtgggagtaggtcgtgggggtgacgggttcctgccaatcgatggttgacaagtcgtcggcggcttgttggtaggtaaggtggatcattggctgtttgagtgcagcgccatgccagtgtctctggccggcgtcgatccagatggattcgcccttggtcaggtgctggggtgcttgtccttcaatatggaccagggcaacgccgcccgtgacgtagaggccctgtcccttggggtgtgtgcctcagcggcaaacgtgacggcgtgggcggcacgcccggcgtcttccgtggcacgatcggccggatccatggcggcgcgcagctgctgttctgcagccaggcgtccaggtcacggcgggcagcatcgacacccagggcagcctcgacggcttcagggctacgacgctggccgggctggttgaccgcagaccactggtgccgggcgtcgtccagatcatggccggcggcgtcgatgagggcggtggtggcttcggcgcagcatcgcctgatccactccgaacgtgacaggccagctgtctcggcggcactgtcatgcgcgccaggagagatttcatgggcgctcatctgtagcctccagataggcgttgatgtagcgcagagcctgatccgtcatgtcgatggcggctgcctcggcagacgacacaacgggctgtggatgataagaccacccaacatagacggcgaacatcaatttctcgacagctttcatgaggtccccggcggcaaccgcatccgcctcatcatccgaggagaaccacttcaggtctgaacggctgtacatagcccctaggtcctgatgtgggtcgaggtccttg

SEQ ID NO: 264 - DNA, 3861 bp, Propionibacterium acnes
gctgagaaaaattttgggtccgccctgcatatcggggcctcttcataccttcaaaagtgtgaaggggaatacagactcttcgactggaattaaaatggtatatggcgtgtccgggccgcacccagctccacgatgcgccataggggagccataacttcaccaatcgtatacgatatgagtgtgggtgagcatctaccggtggccgacagtcagatacaagcatgggcggatgaagcagaagctgattatgacctcagcatgcttccgccgtctcgacgtggtcgcccaccggtggggaggggcccgggcactgtggtccctgtgcgcttcgacgcggacactctcaaggcgttgtcacaacgagcccatgacgaaggattgaccacgcgttctgacgcgatccgtgctgcggttaaccagtggctcggcctcggctcgtaaacattatcggcgcgacaaccttactgatgacgctgttggttacgccgtagagcacatcttgtactcgtgggcgctcgacgatgctgatgatcctcggtgctggatgatgattcggtgttgacccagctggcctcctcatggagctagttatcctcatctacgacgatggctatgaactcctgatccacgccatgaaagcccgccctcagtatctgagctacttcgctatctagtgttgttgggcgagttgaactcaacttttctccgacgcaagcgccaataaaaggctgatccatccgaataccaccaaacacggctgaagtgtggaacagattcagcaagacagggtgcggtgctcgggtgcgttggggagatgaggatattcaggcttctggcgggatgtggcttgatgacgtccaggatcaccggttcggttttgaaggtgccttgcattaatgtcgacagggtcgtacgactcgaggattggatcgaccagcccgttgcgtctgaagaacttcatccaccccggtggagctccggccgcgtactggtgcaacggatcattagcatgggtagcgtgagtatgccttcgatcgtggtcagtgctgtcatcatccaagattctgacgggcggcttctcactgtccgtaaacgaggcaccgaggcattcatgctgccaggcggcaagccggagcccggcgaggactcgcgtcaggcagtagtccgggaagtgcacgaagagctcggcgtcgcattgtcttccgacgacctgcgtcgggtgggagtgttcaccacgcgagcagcgaatgaggccggccatcaggtggtggcgacgattttcacccacaccccggttgcggtgagtgagccagctgctgagatcgagcagattcgttggctcgattggagtgtcgacgccctgcctgacgacctggccccgctgctggtcgaggcagtcatcccgtggctgcggcgccgtatccggtcggtcgctgtattcacgggtgcgaaggatggaaccgaccctcattatcgtgtcgaagcaaccgccttgggccggggtctcgcacacgccgggatcaccctggtttatggcggcgggaaggtcgggatgatgggtgctgttgctgatgcggccctcgctgctggcggcgctgtgatcggagtgatgccgcagcacttggtggacggggagatcgcccatcctagtctgactcacctcgaggtagtgcggactatgcatgagcgcaagcagcggatgagtgacctagctgacgcgttcgtcgcgctacccggcggcggcggaacccttgacgagctattcgaagcatggacatggcagcagctcggtgtacacagcaaacccgtggccttgtacgactcgaccttctgggcaccgctgaccgcgctactcaaccacatgaccatcgaaggcttcatccgccctgaggaccgcgcctcgctcgtgatcgccgataccatacatcagctgatggccgatcttgagggatggaccccaccaccaccgaagtggcgctcgtgacatagaacaaatgattctgactatggctcattgacatctgcgcagcggctactagctccattgacttcaaatcgggccttggccgaggctcggttcaggtggcccggaatggatccccacaaattgaatgctcatgatcgaggtgatgaacgcccactctattgtcctacgcccggttgtatccagcgagcaattgaaggtgctgcgcctgttggtcgaccaggccgagccactcatcatcgacgggcgcatcttgtacgaggcatgggacaggctgcaaacagcccgtccggcccgctagaaaaaatttttagggcccgctccgcacatcccggtctgtacccacaccttcaagggtgtgaagggaataaaaacacacctaacaacaactttgtttcatgatttggcgcgtcggaccctttctgaccgatgtcgtgcgcaacaatggacccatgagttcgcctaccaagatgcgccggaaggggacacgcggcccgaaacctcgcagcgacgaggagctaacggctgtgatgttccgcgtcccagagtcagtggccgaacgtgtcagcgatatggcttgggagctgaggctctcccgatccgatcttgtgggctggtcggccctctatgcactcaactcgatgctcagacagcgcggagaggacacgattccggttccggagtatctggacaaggccgtgctcgctgcgttgtatcccgatgggttgcccttcgacgaggacaacgaggagccgggcgagaatgccgggcaggaggagcttgcgatgactggatgagcccgaacatggttgaaggccgccccgccaggcgaccttcaatcaatggtttcggttgtcagctgcagccacccttgccaggtgctgtggttcttctccagaggaggagggaccgccatgaagaccaagaagacctagaagatccaaaagaaccggtttcggctgttgcttcggtcttcatggtagctgatagcccgcgtcgttggaagtgcgacgacgccgatcctcatcggtatcgcaccctgttccagggtcgagaatgtgaaggattaacaaccatgacaagtcatgaggcgtcctcccggagggcgtcatgaccgctttaattcaagctctgccgacagctgaactgtctgctggacctggtgctagcggtccagctagaccctctgctgagggcttcatcaagattcatcacgaccttattagtgcgggcgtgtcgggtaacgcgatggcgttgttcgtcgcgttacgtaaccagcccggctgtgatcagtggacccgtcactcgtacctgcggctagcccaatggtgcggctgggatgggctgtcggaggcggcgggctgtaagcgggtgcagcgggccgctgctgagctcgctagcggtggttggctggaatcgcgggtcggccatgatcgtcgcaccgctaagacgctggtgtggcatcggttgaccagccccgacaccgaccgctgggagcaattgccgcggattgtgtgggcgaggatctgccagatcgccggggagacgtcgggagagtgggtgaggcattggctggtgtggcggatgctggccggtcgtactggtgtggctcaggcccctatgtccatcgtggctcggttcctgggctgttcttcgcgccaggtctctcatatccgtggggctctcgttgatgccggtctgctcggctgtgacgaggtgtcgggggcggcgagccgggtgtggttcccctcgatggccgaggagtgtgcagcggatcgtgaggtggtcgatggggccgtcgtcggtgctggggtgggctctggtgaaggtgtcgaggagggcggggaacccctgtcgattttgtccacccacccctg

SEQ ID NO: 265 - DNA, 2093 bp, Propionibacterium acnes
caggtgggtttgaccgccagcgtcggattggtgctggtcgctgggctgatcaccactctcaaccgtcgttaccggacccggttcacccgccagccccgcggcaaggccatgaccctgcccagcccggacgcccaaactgccgagatagcgctgcgcagcaccagagcagccgagactctgacgatcacctgcctcgaccacgcgctccgcgcgatcggcgcatggtgccaccactgcgggcacccgctgccacccctgctggccgcccgcgtcgatgacgaccggatcgacctgctgctatcccaggcggcccccgaccatcccgaggcggtggagctggccgccgacggatcggtgtggaccctcaccgccgaccggatcgacgacctgctagcccacaccgatgacaaccaagcggctccgtggccgtctctggtcacactgggacgcgacgacgacggcgcccacatcctcatcgacttggaagccgcaggaaccttgcacctgatcgccgatgacgaccaggtcgacgcggccctcgccgcgatcgccgtggaactggccacctgtgactggtccgacgaggtcaacgtcaccctggtcggccaggtgtgcccgggcctagaagacgcactagagtctccgaccctgacccgcgccaccgacgtggacgccctcctcaccaccctggaagctcgcgccgacgaccagcgacacatcctcaccgaaggaagccccctcgccgctcaccgagccgaccccgccatctccgacgggttcgacgccgaagtgatcctcctcgacaccgaactcaccgaagaccaccgcaaccgcctcgccagcctcgtcgaggctcttccccgcgtgtcagtcgccgcggtaacaaccagccccaccagcccacacgaatggtccctcaccctgacaggtgacccactagccgccgacgtggctcccctcggctggcacatccacccccaaaccctctcccccgacctgtacaaccgcgtggttgaactactcgccaactccgccgccgcagactacgaacccgccagctggtggaaccacgacgccgacgacgagcccaccaccggccccaccaacgaggaagaatctaccccgagcaggcgagcccgcccgaatatccgcctgaccaccctgaccggcggcatcgacctatccagcgtcgacatcgacgacatcatcgacgaagccaaccaggccctcgacaacaccgacgaggccaccgaccaggttcgtgtcgacaccgaccaacccggcaccgacacccccttccccatcgacgacatcgacccgctgagctccgaccacccggtcctatccatcatcggccaccccgacatcacaggtgccactggaaccgttgggcgctccccgtggcgctgccaacagttggccctctacatcgctgagcatccgggagcatcgggggcgactatcgccgatgatttggggctatcagcgtcgacggtgcgctcgattgctacacacctgcgacactggttgggagccgacgatgccggggtggcttacatgccggcggcgacgcgcggctaccggctcgatgagcggatcgtcacagatgtggacctgatcgacgctgctgtggccggggcaggcattaacaccgctgagacggccacactggtggccattttgaagctgggccgcggacgggtcttcgctggggttcctgaatcggaacttcgccagttcagggcgtcgatgtaccacgtggaggcccgcatcgtcgatgctgccctccaagtgacagaccgggccctggaagccggggacctggggctggcccggtgggcgttgacccaagggctactggtgtctcccgatcatgaggacctggtcgccggttgtctgcgcaccgagtaccaggccggcaacatggacaaggtcgccgagctggtcgatcacctgtcggctaccgcacgccgactgggcgtcgacctcaacgaggacaccacccggatcatcgatacggtcacccacgccgacaggagagcatcatgatctcccctgcactcatctccgtcaggaaggttcctatgcaccat

SEQ ID NO: 266 - DNA, 650 bp, Propionibacterium acnes
tgcgggtacacctaccagcaggcagccccggaaggcggttataaggtcaccgcaatcacgtcgtgggatgtgacctggtcggtactaggacacacgggcacagtccacatccagaaggccggtgggcagatgcttccggtcggcgagttggagtctgttgttacacggcgatgactcctgatagtccgacgctgtatgaggtgttgggggtctgccctgataccactgatgaccagatcaagacggcgtggcgtcgtgccgcgaaagtgactcaccctgatgccggtggcactagtgaggcgttcgcggccgcccggcacgcctgggaggtgttgtctgatcctgcccggcgcaccgcctacgatgccgacctggcggaggaggatgatcccgacgacgaagccgccgacgccttcgacgttgatccgttcacggcatggccctggtgcgccccgtacatcgacgccacccccaccctgcgccacacctgccccggcacgatcaaggccatcgtggtcgccatcgccgggatcatggccggaatcggctggcaggaagcgctggaggccgtggtgtcgccgccggggtttctgggggcgtgctggatagtctcagtgccggttgtcgtcgcagtgacatggctggcagcg

SEQ ID NO: 267 - DNA, 3863 bp, Propionibacterium acnes
gctgagaaaaattttgggtccgccctgcatatcggggcctcttcataccttcaaaagtgtgaaggggaatacagactcttcgactggaattaaaatggtatatggcgtgtccggtccgcacccagctccacgatgcgccataggggagccataacttcaccaatcgtatacgatatgagtgtgggtgagcatctaccggtggccgacagtcagatacaagcatgggcggatgaagcagaagctgattatgacctcagcatgcttccgccgtctcgacgtggtcgcccaccggtggggaggggcccgggcactgtggtccctgtgcgcttcgacgcggacactctcaaggcgttgtcacaacgagcccatgacgaaggattgaccacgcgttctgacgcgatccgtgctgcggttaaccagtggctcggcctcggctcgtaaacattatcggcgcgacaaccttactgatgacgctgttggttacgccgtagagcacatcttgtactcgtgggcgctcgacgatgctgatgatcctcgttgctggatgatgattcggtgttgacccagctggcctcctcatggagctagttatcctcatctacgacgatggctatgaactcctgatccacgccatgaaagcccgccctcagtatctgagctacttcgctatctagtgttgttgggcgagttgaactcaacttttctccgacgcaagcgccaataaaaggctgatccatccgaataccaccaaacacggctgaagtgtggaacagattcagcaagacagggtgcggtgctcgggtgcgttggggagatgaggatattcaggcttctggcgggatgtggcttgatgacgtccaggatcaccggttcggttttgaaggtgccttgcattaatgtcgacagggtcgtacgactcgaggattggatcgaccagcccgttgcgtctgaagaacttcatccaccccggtggagctccggccgcgtactggtgcaacggatcattagcatgggtagcgtgagtatgccttcgatcgtggtcagtgctgtcatcatccaagattctgacgggcggcttctcactgtccgtaaacgaggcaccgaggcattcatgctgccaggcggcaagccggagcccggcgaggactcgcgtcaggcagtagtccgggaagtgcacgaagagctcggcgtcgcattgtcttccgacgacctgcgtcgggtgggagtgttcaccacgcgagcagcgaatgaggccggccatcaggtggtggcgacgattttcacccacaccccggttgcggtgagtgagccagctgctgagatcgagcagattcgttggctcgattggagtgtcgacgccctgcctgacgacctggccccgctgctggtcgaggcagtcatcccgtggctgcggcgccgtatccggtcggtcgctgtattcacgggtgcgaaggatggaaccgaccctcattatcgtgtcgaagcaaccgccttgggccggggtctcgcacacgccgggatcaccctggtttatggcggcgggaaggtcgggatgatgggtgctgttgctgatgcggccctcgctgctggcggcgctgtgatcggagtgatgccgcagcacttggtggacggggagatcgcccatcctagtctgactcacctcgaggtagtgcggactatgcatgagcgcaagcagcggatgagtgacctagctgacgcgttcgtcgcgctacccggcggcggcggaacccttgacgagctattcgaagcatggacatggcagcagctcggtgtacacagcaaacccgtggccttgtacgactcgaccttctgggcaccgctgaccgcgctactcaaccacatgaccatcgaaggcttcatccgccctgaggaccgcgcctcgctcgtgatcgccgataccatacatcagctgatggccgatcttgagggatggaccccaccaccaccgaagtggcgctcgtgacatagaacaaatgattctgactatggctcattgacatctgcgcagcggctactagctccattgacttcaaatcgggccttggccgaggctcggttcaggtggcccggaatggatccccacaaattgaatgctcatgatcgaggtgatgaacgcccactctattgtcctacgcccggttgtatccagcgagcaattgaaggtgctgcgcctgttggtcgaccaggccgagccactcatcatcgacgggcgcatcttgtacgaggcatgggacaggctgcaaacagcccgtccggcccgctagaaaaaatttttagggcccgctccgcacatcccggtctgtacccacaccttcaagggtgtgaagggaataaaaacacacctaacaacaactttgtttcatgatttggcgcgtcggaccctttctgaccgatgtcgtgcgcaacaatggacccatgagttcgcctaccaagacccgccggaaggggacacgcggcccgaaacctcgcagcgacgaggagctaacggctgtgatgttccgcgtcccagagtcagtggccgaacgtgtcagcgatatggcttgggagctgaggctctcccgatccgatcttgtgggctggtcggccctctatgcactcaactcgatgctcagacagcgcggagaggacacgattccggttccggagtatctggacaaggccgtgctcgctgcgttgtatcccgatgggttgcccttcgacgaggacaacgaggagccgggcgagaatgccgggcaggaggagcttgcgatgactggatgagcccgaacatggttgaaggccgccccgccaggcgaccttcaatcaatggtttcggttgtcagctgcagccacccttgccaggtgctgtggttcttctccagaggaggagggaccgccatgaagaccaagaagacctagaagatccaaaagaaccggtttcggctgttgcttcggtcttcatggtagctgatagcccgcgtcgttggaagtgcgacgacgccgatcctcatcggtatcgcaccctgaaacagggtgttgaacatgaagggttgaccgctatgtcaagccatgagacgccctcccggagggcgtcatgaccgctttaattcaagctctgccgacagctgaactgtctgctggacctggtgctagcagtccagctagaccctctgctgagggcttcatcaagattcatcacgacctcattagtgcgggcgtgtcgggtaacgcgatggcgttgttcgtcgcgttacgtaaccagcccggctgtgatcagtggacccgtcactcgtacctgcggctagcccaatggtgcggctgggatgggctgtcggaggcggcgggctgtaagcgggtgcagcgggccgctgctgagctcgctagcggtggttggctggaatcgcgggtcggccatgatcgtcgcaccgctaagacgctggtgtggcatcggttgaccagccccgacaccgaccgctgggagcaattgccgcggattgtgtgggcgaggatctgccagatcgccggagagacgtcgggagagtgggtgaggcattggctggtgtggcggatgctggccggtcgtactggtgtggctcaggcccctacgtccatcgtggcccggttcctgggctgttcttcgcgccaggtctctcatatccgtggggctctcgttgatgccggtctgctcggctgtgacgaggtgtcgggggcggcgagccgggtgtggttcccctcgatggccgaggagtgtgcagcggatcgtgaggtggtcgatggggccgtcgtcggtgctggggtgggctctggtgaaggtgtcgaggagggcggggaacccctgtcgattttgtccacccacccctgtc

SEQ ID NO: 268 - DNA, 653 bp, Propionibacterium acnes
acgtgcgggtacacctaccagcaggcagcaccagcggggggctataaggtcaccgcaatcacgtcgtgggatgtgacctggtcggtactaggacacacgggcacagtccacatccagaaggccggtgggcagatgcttccggtcggcgagttggagtctgttgttacacggcgatgactcctgatagtccgacgctgtatgaggtgttgggggtctgccctgatgccactgatgaccagatcaagacggcgtggcgtcgtgccgcgaaagtgactcaccctgatgccggtggcactagtgaggcgttcgcggccgcccggcacgcctgggaggtgttgtctgatcctgcccggcgcaccgcctacgatgccgacctggcgggggaggatgatcccgacgacgaagccgccgacgccttcgacgttgatccgttcacggcatggccctggtgcgccccgtacatcgacgccacccccaccctgcgccacacctgccccggcacgatcaaggccatcgtggtcgccatcgccgggatcatggccggaatcggctggcaggaagcgctggaggccgtggtgtcgccgccggggtttctgggggcgtgctggatagtctcagtgccggttgtcgtcgcagtgacatggctggcagcg

SEQ ID NO: 269 - DNA, 3862 bp, Propionibacterium acnes
gctgagaaaaattttgggtccgccctgcatatcggggcctcttcataccttcaaaagtgtgaagggaatacagactcttcgactggaattaaaatggtatatggcgtgtccggtccgcacccagctccacgatgcgccatagaggagccataacttcaccaatcgtatacgatatgagtgtaggtgagcatctaccggtggccgacagtcagatacaagcatgggcggatgaagcagaagctgattatgacctcagcatgcttccgccgtctcgacgtggtcgcccaccggtggggaggggcccgggcactgtggtccctgtgcgcttcgacgcggacactctcaaggcgttgtcacaacgagcccatgacgaaggattgaccacgcgttctgacgcgatccgtgctgcggttaaccagtggctcggcctcggctcgtaaacattatcggcgcgacaaccttactgatgacgctgttggttacgccgtagagcacatcttgtactcgtgggcgctcgacgatgctgatgatcctcgttgctggatgatgattcggtgttgacccagctggcctcctcatggagctagttatcctcatctacgacgatggctatgaactcctgatccacgccatgaaagcccgccctcagtatctgagctacttcgctatctagtgttgttgggcgagttgaactcaacttttctccgacgcaagcgccaataaaaggctgatccatccgaataccaccaaacacggctgaagtgtggaacagattcagcaagacagggtgcggtgctcgggtgcgttggggagatgaggatattcaggcttctggcgggatgtggcttgatgacgtccaggatcaccggttcggttttgaaggtgccttgcattaatgtcgacagggtcgtacgactcgaggattggatcgaccagcccgttgcgtctgaagaacttcatccaccccggtggagctccggccgcgtactggtgcaacggatcattagcatgggtagcgtgagtatgccttcgatcgtggtcagtgctgtcatcatccaagattctgacgggcggcttctcactgtccgtaaacgaggcaccgaggcattcatgctgccaggcggcaagccggagcccggcgaggactcgcgtcaggcagtagtccgggaagtgcacgaagagctcggcgtcgcattgtcttccgacgacctgcgtcgggtgggagtgttcaccacgcgagcagcgaatgaggccggccatcaggtggtggcgacgattttcacccacaccccggttgcggtgagtgagccagctgctgagatcgagcagattcgttggctcgattggagtgtcgacgccctgcctgacgacctggccccgctgctggtcgaggcagtcatcccgtggctgcggcgccgtatccggtcggtcgctgtattcacgggtgcgaaggatggaaccgaccctcattatcgtgtcgaagcaaccgccttgggccggggtctcgcacacgccgggatcaccctggtttatggcggcgggaaggtcgggatgatgggtgctgttgctgatgcggccctcgctgctggcggcgctgtgatcggagtgatgccgcagcacttggtggacggggagatcgcccatcctagtctgactcacctcgaggtagtgcggactatgcatgagcgcaagcagcggatgagtgacctagctgacgcgttcgtcgcgctacccggcggcggcggaacccttgacgagctattcgaagcatggacatggcagcagctcggtgtacacagcaaacccgtggccttgtacgactcgaccttctgggcaccgctgaccgcgctactcaaccacatgaccatcgaaggcttcatccgccctgaggaccgcgcctcgctcgtgaccgccgataccatacatcagctgatggccgatcttgagggatggaccccaccaccaccgaagtggcgctcgtgacatagaacaaatgattctgactatggctcattgacatctgcgcagcggctactagctccattgacttcaaatcgggccttggccgaggctcggttcaggtggcccggaatggatccccacaaattgaatgctcatgatcgaggtgatgaacgcccactctattgtcctacgcccggttgtatccagcgagcaattgaaggtgctgcgcctgttggtcgaccaggccgagccactcatcatcgacgggcgcatcttgtacgaggcatgggacaggctgcaaacagcccgtccggcccgctagaaaaaatttttagggcccgctccgcacatcccggtctgtacccacaccttcaagggtgtgaagggaataaaaacacacctaacaacaactttgtttcatgatttggcgcgtcggaccctttctgaccgatgtcgtgcgcaacaatggacccatgagttcgcctaccaagacccgccggaaggggacacgcggcccgaaacctcgcagcgacgaggagctaacggctgtgatgttccgcgtcccagagtcagtggccgaacgtgtcagcgatatggcttgggagctgaggctctcccgatccgatcttgtgggctggtcggccctctatgcactcaactcgatgctcagacagcgcggagaggacacgattccggttccggagtatctggacaaggccgtgctcgctgcgttgtatcccgatgggttgcccttcgacgaggacaacgaggagccgggcgagaatgccgggcaggaggagcttgcgatgactggatgagcccgaacatggttgaaggccgccccgccaggcgaccttcaatcaatggtttcggttgtcagctgcagccacccttgccaggtgctgtggttcttctccagaggaggagggaccgccatgaagaccaagaagacctagaagatccaaaagaaccggtttcggctgttgcttcggtcttcatggtagctgatagcccgcgtcgttggaagtgcgacgacgccgatcctcatcggtatcgcaccctgaaacagggtgttgaacatgaagggttgaccgctatgtcaagccatgagacgccctcccggagggcgtcatgacctctttaattcaagctctgccgacagctgaactgtctgctggacctggtgctagcagtccagctagaccctctgctgagggcttcatcaagattcatcacgacctcattagtgcgggcgtgtcgggtaacgcgatggcgttgttcgtcgcgttacgtaaccagcccggctgtgatcagtggacccgtcactcgtacctgcggctagcccaatggtgcggctgggatgggctgtcggaggcggcgggctgtaagcgggtgcagcgggccgctgctgagctcgctagcggtggttggctggaatcgcgggtcggccatgatcgtcgcaccgctaagacgctggtgtggcatcggttgaccagccccgacaccgaccgctgggagcaattgccgcggattgtgtgggcgaggatctgccagatcgccggggagacgtcgggagagtgggtgaggcattggctggtgtggcggatgctggccggtcgtactggtgtggctcaggcccctatgtccatcgtggctcggttcctgggctgttcttcgcgccaggtctctcatatccgtggggctctcgttgatgccggtctgctcggctgtgacgaggtgtcgggggcggcgagccgggtgtggttcccctcgatggccgaggagtgtgcagcggatcgtgaggtggttgatggggccgtcgtcgatgctggggtgggctctggtgaaggtgtcgaggagggcggggaacccctgtcgattttgtccacccacccctgtc

SEQ ID NO: 270 - DNA, 2238 bp, Propionibacterium acnes
gacgccggccaccccaactactccgacccacacggtgaccccagctccggcctctgccggccactcgaccagcgacgagcacccactccatacggataccgccgcagcggacaaggccagcaacgaggacgccctgtccccaatccaggtgggtttgaccgccagcgtcggactggtgctggtcgccggactgatcaccaccctcaaccgccgctaccggacccggttcacccgccagccccgcggcaaggccatgaccctgcccagcccggacgcccaaactgccgagatagcgctgcgcagcaccggggcgactgacactctgacgatcacctgcctcgaccaggcgctccgcgcgatcggcgcatggtgccaccactgcgggcacccgctgccacccctgctggccgcccgcgtcgatgacgaccggatcgacctgctgctatcccaggcggcccccgaccatcccgaggcggtggagctggccgccgacggatcggtgtggaccctcaccgccgaccggatcgacgacctgctagcccacaccgatgacaaccaagcggctccgtggccgtctctggtcacactgggacgcgacgacgacggcgcccacatcctcatcgacttggaagccgcaggaaccttgcacctgatcgccgatgacgaccaggtcgacgcggccctcgccgcgatcgccgtggaactggccacctgcgactggtccgacgaagtcaacgtcaccctcgtcggccaggtgtgcccgggcctagaagacgcactagagtctccgaccctgacccgcgccaccgacgtggacaccctcctcaccaccctagaagctcgcgccgacgaccagcgacacatcctcaccgaaggaaaccccctcgccgctcaccgagccgaccccgccatctccgacgggttcgacgccgaagtgatcctcctcgacaccgaactcaccgaagaccaccgcaaccgcctcgccagcctcgtcgaggctcttccccgcgtgtcagtcgccgcggtaacaaccagccccaccagcccagacgaatggtccctcaccctgacaggtgacccactagccgccgacctggctcccctcggctggcacatccacccccaaaccctctcccccgacctgtacaaccgcatggttgaactactcgccaactccgccgccgcagactacgaacccgccagctggtggaaccacgacgccgacgacgagcccaccaccgaccccaccaacgaggaagaatctaccccgagcaggcgagcccgcccgaatatccgcctgaccaccctgaccggcggcatcgacctatccagcgtcgacatcgacgacatcatcgacgaagccaaccaagccctcgacaacaccgaccagaccaccaaccaggttcgcgtcgacaccgaccaacccggcaccgacacccccttccccatcgacgacatcgacccgctgagctccgaccacccggtcctatccatcatcggccacccccacatcacaggtgccactggaaccgttgggcgctccccgtggcgctgccaacagttggccctctacatcgctgagcatccgggagcatcgggggcgactatcgccgatgatttggggctatcagcgtcgacggtgcgctcgattgctacacacctgcgacactggttgggagccgacgatgccggggtggcttacatgccggcggcgacgcgcggctaccggctcgatgagcggatcgtcacagatgtggacctgatcgacgctgctgtggccggggcaggcattaacaccgctgagacggccacactggtggccattttgaagctgggccgcggacgggtcttcgctggggttcctgactcggaacttcgccagttcagggcgtcgatgtaccacgtggaggcccgcatcgtcgatgctgccctccaagtgacagaccgggccctggaagccggagacttggggctggcccggtgggcgttgacccaagggctactggtgtctcccgatcatgaggacctggtcgccggttgtctgcgcaccgagtaccaggccggcaacatggacaaggtcgccgagctggtcgatcacctgtcggctaccgcacgccgactgggcgtcgacctcaacgaggacaccacccggatcatcgatacggtcacccacgccgacaggagagcatcatgatctcccctgcactcatctccgtcaggaaggttcctatgcaccat

SEQ ID NO: 271 - DNA, 739 bp, Propionibacterium acnes
acgtgcgggtacacctaccagcaggcagcaccagcggggggctataaggtcaccgcaatcacgtcgtgggatgtgacctggtcggtactaggacacacgggcacagtccatatcgagaaggccggtgggcagatgcttccggtcggcgagttggagtctgttgttacacggcgatgactcctgatagtccgacgctgtatgaggtgttgggggtctgccctgatgccactgatgaccagatcaagacggcgtggcgtcgtgccgcgaaagtgactcaccctgatgccggtggcactagtgaggcgttcgcggccgcccggcacgcctgggaggtgttgtctgatcctgcccggcgcaccgcctacgatgccgacctggcgggggaggatgatcccgacgacgaagccgccgacgccttcgacgttgatccgttcacggcatggccctggtgcgccccgtacatcgacgccacccccaccctgcgccacacctgccccggcacgatcaaggccatcgtggtcgccatcgccgggatcatggccggaatcggctggcaggaagcgctggaggccgtggtgtcgccgccggggtttctgggggcgtgctggatagtctcagtgccggttgtcgtcgcagtgacatggctggcagcggtgacgggtctggcatttttcaccatggcggccatctggtgtggatggtcgttgataggtggtgcgttgctgtggggccagacgtc

SEQ ID NO: 272 - DNA, 3863 bp, Propionibacterium acnes
gctgagaaaaattttgggtccgccctgcatatcggggcctcttcataccttcaaaagtgtgaaggggaatacagactcttcgactggaattaaaatggtatatggcgtgtccggtccgcacccagctccacgatgcgccatagaggagccataacttcaccaatcgtatacgatatgagtgtgggtgagcatctaccggtggccgacagtcagatacaagcatgggcggatgaagcagaagctgattatgacctgagcatgcttccgccgtctcgacgtggtcgcccaccggtggggaggggcccgggcactgtggtccctgtgcgcttcgacgcggacactctcaaggcgttgtcacaacgagcccatgacgaaggattgaccacgcgttctgacgcgatccgtgctgcggttaaccagtggctcggcctcggctcgtaaacattatcggcgcgacaaccttactgatgacgctgttggttacgccgtagagcacatcttgtactcgtgggcgctcgacgatgccgatgatcctcgttgctggatgatgattcggtgttgacccagctggcctcctcatggagctagttatcctcatctacgacgatggctatgaactcctgatccacgccatgaaagcccgccctcagtatctgagctacttcgctatctagtgttgttgggcgagttgaactcaacttttctccgacgcaagcgccaataaaaggctgatccatccgaataccaccaaacacggctgaagtgtggaacagattcagcaagacagggtgcggtgctcgggtgcgttggggagatgaggatattcaggcttctggcgggatgtggcttgatgacgtccaggatcaccggttcggttttgaaggtgccttgcattaatgtcgacagggtcgtacgactcgaggactggatcgaccagcccgttgcgtctgaagaacttcatccaccccggtggagctccggccgcgtactggtgcaacggatcattagcatgggtagcgtgagtatgccttcgatcgtggtcagtgctgtcatcatccaagattctgacgggcggcttctcactgtccgtaaacgaggcaccgaggcattcatgctgccaggcggcaagccggagcccggcgaggactcgcgtcaggcagtagtccgggaagtgcacgaagagctcggcgtcgcattgtcttccgacgacctgcgtcgggtgggagtgttcaccacgcgagcagcgaatgaggccggccatcaggtggtggcgacgattttcacccacaccccggttgcggtgagtgagccagctgctgagatcgagcagattcgttggctcgattggagtgtcgacgccctgcctgacgacctggccccgctgctggtcgaggcagtcatcccgtggctgcggcgccgtatccggtcggtcgctgtattcacgggtgcgaaggatggaaccgaccctcattatcgtgtcgaagcaaccgccttgggccggggtctcgcacacgccgggatcaccctggtttatggcggcggggagggcgggatgatgggtgctgttgctgatgcggccctcgctgctggcggcgctgtgatcggagtgatgccgcagcacttggtggacggggagatcgcccatcctagtctgactcacctcgaggtagtgcggactatgcatgagcgcaagcagcggatgagtgacctagctgacgcgttcgtcgcgctacccggcggcggcggaacccttgacgagctattcgaagcatggacatggcagcagctcggtgtacacagcaaacccgtggccttgtacgactcgaccttctgggcaccgctgaccgcgctactcaaccacatgaccatcgaaggcttcatccgccctgaggaccgcgcctcgctcgtgatcgccgataccatacatcagctgatggccgatctcgagggatggaccccaccaccaccgaagtggcgctcgtgacatagaacaaatgattctgactatggctcattgacatctgcgcagcggctactagctccattgacttcaaatcgggccttggccgaggctcggttcaggtggcccggaatggatccccacaaattgaatgctcatgatcgaggtgatgaacgcccactctattgtcctacgcccggttgtatccagcgagcaattgaaggtgctgcgcctgttggtcgaccaggccgagccactcatcatcgacgggcgcatcttgtacgaggcatgggacaggctgcaaacagcccgtccggcccgctagaaaaaatttttagggcccgctccgcacatcccggtctgtacccacaccttcaagggtgtgaagggaataaaaacacacctaacaacaactttgtttcatgatttggcgcgtcggaccctttctgaccgatgtcgtgcgcaacaatggacccatgagttcgcctaccaagacccgccggaaggggacacgcggcccgaaacctcgcagcgacgaggagctaacggctgtgatgttccgcgtcccagagtcagtggccgaacgtgtcagcgatatggcttgggagctgaggctctcccgatccgatcttgtgggctggtcggccctctatgcactcaactcgatgctcagacagcgcggagaggacacgattccggttccggagtatctggacaaggccgtgctcgctgcgttgtatcccgatgggttgcccttcgacgaggacaacgaggagccgggcgagaatgccgggcaggaggagcttgcgatgactggatgagcccgaacatggttgaaggccgccccgccaggcgaccttcaatcaatggtttcggttgtcagctgcagccacccttgccaggtgctgtggttcttctccagaggaggagggaccgccatgaagaccaagaagatctagaagatccaaaagaaccggtttcggctgttgcttcggtcttcatggtagctgatagcccgcgtcgttggaagtgcgacgacgccgatcctcatcggtatcgcaccctgaaacagggtgttgaacatgaagggttgaccgctatgtcaagtcatgagacgccctcccggagggcgtcatgaccgctttaattcaagctctgccgacagctgaactgtctgctggacctggtgctagcagtccagctagaccctctgctgagggcttcatcaagattcatcacgaccttattagtgcgggcgtgtcgggtaacgcgatggcgttgttcgtcgcgttacgtaaccagcccggctgtgatcagtggacccgtcactcgtacctgcggctagcccaatggtgcggctgggatgggctgtcggaggcggcgggctgtaagcgggtgcagcgggccgctgctgagctcgctagcggtggttggctggaatcgcgggtcggccatgatcgtcgcaccgctaagacgctggtgtggcatcggttgaccagccccgacaccgaccgctgggagcaattgccgcggattgtgtgggcgaggatctgccagatcgccggggagacgtcgggagagtgggtgaggcattggctggtgtggcggatgctggccggtcgtactggtgtggctcaggcccctacgtccatcgtggctcggttcctgggctgttcttcgcgccaggtctctcatatccgtggggctctcgttgatgccggtctgctcggctgtgacgaggtctcgggggcggcgagccgggtgtggttcccctcgatggccgaggagtgtgcagcggatcgtgaggtggtcgatggggccgtcgtcggtgctggggtgggctctggtgaaggtgtcgaggagggcggggaacccctgtcgattttgtccacccacccctgtc

SEQ ID NO: 273 - DNA, 2238 bp, Propionibacterium acnes; identical to SEQ ID NO: 215

SEQ ID NO: 274 - DNA, 3865 bp, Propionibacterium acnes
gctgagaaaaattttgggtccgccctgcatatcggggcctcttcataccttcaaaagtgtgaaggggaatacagactcttcgactggaattaaaatggtatatggcgtgtccggtccgcacccagctccacgatgcgccatagaggagccataacttcaccaatcgtatacgatatgagtgtgggtgagcatctaccggtggccgacagtcagatacaagcatgggcggatgaagcagaagctgattatgacctgagcatgcttccgccgtctcgacgtggtcgcccaccggtggggaggggcccgggcactgtggtccctgtgcgcttcgacgcggacactctcaaggcgttgtcacaacgagcccatgacgaaggattgaccacgcgttctgacgcgatccgtgctgcggttaaccagtggctcggcctcggctcgtaaaaattatcggcgcgacaaccttactgatgacgctgttggttacgccgtagagcacatcttgtactcgtgggcgctcgacgatgccgatgatcctcgttgctggatgatgattcggtgttgacccagctggcctcctcatggagctagttatcctcatctacgacgatggctatgaactcctgatccacgccatgaaagcccgccctcagtatctgagctacttcgctatctagtgttgttgggcgagttgaactcaacttttctccgacgcaagcgccaataaaaggctgatccatccgaataccaccaaacacggctgaagtgtggaacagattcagcaagacagggtgcggtgctcgggtgcgttggggagatgaggatattcaggcttctggcgggatgtggcttgatgacgtccaggatcaccggttcggttttgaaggtgccttgcattaatgtcgacagggtcgtacgactcgaggactggatcgaccagcccgttgcgtctgaagaacttcatccaccccggtggagctccggccgcgtactggtgcaacggatcattagcatgggtagcgtgagtatgccttcgatcgtggtcagtgctgtcatcatccaagattctgacgggcggcttctcactgtccgtaaacgaggcaccgaggcattcatgctgccaggcggcaagccggagcccggcgaggactcgcgtcaggcagtagtccgggaagtgcacgaagagctcggcgtcgcattgtcttccgacgacctgcgtcgggtgggagtgttcaccacgcgagcagcgaatgaggccggccatcaggtggtggcgacgattttcacccacaccccggttgcggtgagtgagccagctgctgagatcgagcagattcgttggctcgattggagtgtcgacgccctgcctgacgacctggccccgctgctggtcgaggcagtcatcccgtggctgcggcgccgtatccggtcggtcgctgtattcacgggtgcgaaggatggaaccgaccctcattatcgtgtcgaagcaaccgccttgggccggggtctcgcacacgccgggatcaccctggtttatggcggcggggaggtcgggatgatgggtgctgttgctgatgcggccctcgctgctggcggcgctgtgatcggagtgatgccgcagcacttggtggacggggagatcgcccatcctagtctgactcacctcgaggtagtgcggactatgcatgagcgcaagcagcggatgagtgacctagctgacgcgttcgtcgcgctacccggcggcggcggaacccttgacgagctattcgaagcatggacatggcagcagctcggtgtacacagcaaacccgtggccttgtacgactcgaccttctgggcaccgctgaccgcgctactcaaccacatgaccatcgaaggcttcatccgccctgaggaccgcgcctcgctcgtgatcgccgataccatacatcagctgatggccgatctcgagggatggaccccaccaccaccgaagtggcgctcgtgacatagaacaaatgattctgactatggctcattgacatctgcgcagcggctactagctccattgacttcaaatcgggccttggccgaggctcggttcaggtggcccggaatggatccccacaaattgaatgctcatgatcgaggtgatgaacgcccactctattgtcctacgcccggttgtatccagcgagcaattgaaggtgctgcgcctgttggtcgaccaggccgagccactcatcatcgacgggcgcatcttgtacgaggcatgggacaggctgcaaacagcccgtccggcccgctagaaaaaatttttagggcccgctccgcacatcccggtctgtacccacaccttcaagggtgtgaagggaataaaaacacacctaacaacaactttgtttcatgatttggcgcgtcggaccctttctgaccgatgtcgtgcgcaacaatggacccatgagttcgcctaccaagacccgccggaaggggacacgcggcccgaaacctcgcagcgacgaggagctaacggctgtgatgttccgcgtcccagagtcagtggccgaacgtgtcagcgatatggctttggagctgaggctctcccgatccgatcttgtgggctggtcggccctctatgcactcaactcgatgctcagacagcgcggagaggacacgattccggttccggagtatctggacaaggccgtgctcgctgcgttgtatcccgatgggttgcccttcgacgaggacaacgaggagccgggcgagaatgccgggcaggaggagcttgcgatgactggatgagcccgaacatggttgaaggccgccccgccaggcgaccttcaatcaatggtttcggttgtcagctgcagccacccttgccaggtgctgtggttcttctccagaggaggagggaccgccatgaagaccaagaagatctagaagatccaaaagaaccggtttcggctgttgcttcggtcttcatggtagctgatagcccgcgtcgttggaagtgcgacgacgccgatcctcatcggtatcgcaccctgaaacagggtgttgaacatgaagggttgaccgctatgtcaagtcatgagacgccctcccggagggcgtcatgaccgctttaattcaagctctgccgacagctgaactgtctgctggacctggtgctagcagtccagctagaccctctgctgagggcttcatcaagattcatcacgaccttattagtgcgggcgtgtcgggtaacgcgatggcgttgttcgtcgcgttacgtaaccagcccggctgtgatcagtggacccgtcactcgtacctgcggctagcccaatggtgcggctgggatgggctgtcggaggcggcgggctgtaagcgggtgcagcgggccgctgctgagctcgctagcggtggttggctggaatcgcgggtcggccatgatcgtcgcaccgctaagacgctggtgtggcatcggttgaccagccccgacaccgaccgctgggagcaattgccgcggattgtgtgggcgaggatctgccagatcgccggggagacgtcgggagagtgggtgaggcattggctggtgtggcggatgctggccggtcgtactggtgtggctcaggcccctacgtccatcgtggctcggttcctgggctgttcttcgcgccaggtctctcatatccgtggggctctcgttgatgccggtctgctcggctgtgacgaggtctcgggggcggcgagccgggtgtggttcccctcgatggccgaggagtgtgcagcggatcgtgaggtggtcgatggggccgtcgtcggtgctggggtgggctctggtgaaggtgtcgaggagggcggggaacccctgtcgattttgtccacccacccctgtcga

SEQ ID NO: 275 - DNA, 3865 bp, Propionibacterium acnes
gctgagaaaaattttgggtccgccctgcatatcggggcctcttcataccttcaaaagtgtgaaggggaatacagactcttcgactggaattaaaatggtatatgccgtgtccggtccgcacccagctccacgatgcgccataggggagccataacttcaccaatcgtatacgatatgagtgtgggtgagcatctaccggtggccgacagtcagatacaagcatgggcggatgaagcagaagctgattatgacctcagcatgcttccgccgtctcgacgtggtcgcccaccggtggggaggggcccgggcactgtggtccctgtgcgcttcgacgcggacactctcaaggcgttgtcacaacgagcccatgacgaaggattgaccacgcgttctgacgcgatccgtgctgcggttaaccagtggctcggcctcggctcgtaaacattatcggcgcgacaaccttactgatgacgctgttggttacgccgtagagcacatcttgtactcgtgggcgctcgacgatgctgatgatcctcggtgctggatgatgattcggtgttgacccagctggcctcctcatggagctagttatcctcatctacgacgatggctatgaactcctgatccacgccatgaaagcccgccctcagtatctgagctacttcgctatctagtgttgttgggcgagttgaactcaacttttctccgacgcaagcgccaataaaaggctgatccatccgaataccaccaaacacggctgaagtgtggaacagattcagcaagacagggtgcggtgctcgggtgcgttggggagatgaggatattcaggcttctggcgggatgtggcttgatgacgtccaggatcaccggttcggttttgaaggtgccttgcattaatgtcgacagggtcgtacgactcgaggattggatcgaccagcccgttgcgtctgaagaacttcatccaccccggtggagctccggccgcgtactggtgcaacggatcattagcatgggtagcgtgagtatgccttcgatcgtggtcagtgctgtcatcatccaagattctgacgggcggcttctcactgtccgtaaacgaggcaccgaggcattcatgctgccaggcggcaagccggagcccggcgaggactcgcgtcaggcagtagtccgggaagtgcacgaagagctcggcgtcgcattgtcttccgacgacctgcgtcgggtgggagtgttcaccacgcgagcagcgaatgaggccggccatcaggtggtggcgacgattttcacccacaccccggttgcggtgagtgagccagctgctgagatcgagcagattcgttggctcgattggagtgtcgacgccctgcctgacgacctggccccgctgctggtcgaggcagtcatcccgtggctgcggcgccgtatccggtcggtcgctgtattcacgggtgcgaaggatggaaccgaccctcattatcgtgtcgaagcaaccgccttgggccggggtctcgcacacgccgggatcaccctggtttatggcggcgggaaggtcgggatgatgggtgctgttgctgatgcggccctcgctgctggcggcgctgtgatcggagtgatgccgcagcacttggtggacggggagatcgcccatcctagtctgactcacctcgaggtagtgcggactatgcatgagcgcaagcagcggatgagtgacctagctgacgcgttcgtcgcgctacccggcggcggcggaacccttgacgagctattcgaagcatggacatggcagcagctcggtgtacacagcaaacccgtggccttgtacgactcgaccttctgggcaccgctgaccgcgctactcaaccacatgaccatcgaaggcttcatccgccctgaggaccgcgcctcgctcgtgatcgccgataccatacatcagctgatggccgatcttgagggatggaccccaccaccaccgaagtggcgctcgtgacatagaacaaatgattctgactatggctcattgacatctgcgcagcggctactagctccattgacttcaaatcgggccttggccgaggctcggttcaggtggcccggaatggatccccacaaattgaatgctcatgatcgaggtgatgaacgcccactctattgtcctacgcccggttgtatccagcgagcaattgaaggtgctgcgcctgttggtcgaccaggccgagccactcatcatcgacgggcgcatcttgtacgaggcatgggacaggctgcaaacagcccgtccggcccgctagaaaaaatttttagggcccgctccgcacatcccggtctgtacccacaccttcaagggtgtgaagggaataaaaacacgcctaacaacaactttgtttcatgatttggcgcgtcggaccctttctgaccgatgtcgtgcgcaacaatggacccatgagttcgcctaccaagatgcgccggaagggaacacgcggcccgaaacctcgcagcgacgaggagctaacggctgtgatgtgccgcatcccagagtcagtggccgaacgtgtcagcgatatggcttgggagctgaggctctcccgatccgatcttgtgggctggtcggccctctatgcactcaactcgatgctcagacagcgcggagaggacacgattccggttccggagtatctggacaaggccgtgctcactgcgttgtatcccgatgggttgcccttcgacgaggacaacgaggagccgggcgagaatgccgggcaggaggagcttgcgatgactggatgagcccgaacatggttgaaggccgccccgccaggcgaccttcaatcaatggtttcggttgtcagctgcagccacccttgccaggtgctgtggttcttctccagaggaggagggaccgccatgaagaccaagaagacctagaagatccaaaagaaccggtttcagcttttgcttcggtcttcatggtagctgatagcccgcgtcgttggaagtgcgacgacgccgatcctcatcggtatcgcaccctgaaacagggtgttgaacatgaagggttgaccgctatgtcaagccatgagacgccctcccggagggcgtcatgaccgctttaattcaagctctgccgacagctgaactgtctgctggacctggtgctagcagtccagctagaccctctgctgagggcttcatcaagattcatcacgacctcattagtgcgggcgtgtcggggaacgcgatggcgttgttcgtcgcgttacgtaaccagcccggctgtgatcagtggacccgtcactcgtacctgcggctagcccaatggtgcggctgggatgggctgtcggaggcggcgggctgtaagcgggtgcagcgggccgctgctgagctcgctagcggtggttggctggaatcgcgggtcggccatgatcgtcgcaccgctaagacgctggtgtggcatcggttgaccagccccgacaccgaccgctgggagcaattgccgcggattgtgtgggcgaggatctgccagatcgccggggagacgtcgggagagtgggtgaggcattggctggtgtggcggatgctggccggtcgtactggtgtggctcaggcccctacgaccatcgtggcccggttcctgggctgttcttcgcgccaggtctcccatatccgtggggctctcgttgatgccggtctgctcggctgtgacgaggtgtcgggggcggcgagccgggtgtggttcccctcgatggccgaggagtgtgcagcggatcgtgaggtggtcgatggggccgtcgtcgatgctgaggtgggctctggtgaaggtgtcgaggagggcggggaacccctgtcgattttgtccacccacccctgtcga

SEQ ID NO: 276 - DNA, 2889 bp, Propionibacterium acnes
aggcgagcccgccctagtatccgcctgaccaccctgaccggcggcatcgacctatccagcgtcgacatcgacgacatcatcgacgaagccaaccaggccctcgacaacaccgacgaggccaccgaccaggttcgtgtcgacgccgaccaacccggcaccgacacccccttccccatcgacgacatcgacccgctgagctccgaccatccggtcctatccatcatcggccaccccgacatcacaggtgccactggaaccgttgggcgctccccgtggcgctgccaacagttggctctctacatcgctgagcatccgggagcatcgggggcgactatcgccgatgatttggggctatcagcgtcgacggtgcgctcgattgctacacacctgcgacactggttgggagccgacgatgccggggtggcttacatgccggcggcgacgcgcggctaccggctcgatgagcggatcgtcacagatgtggacttgatcgacgctgctgtggccggggcaggcattaacaccgctgagacggccacactggtggccattttgaagctgggccgcggacgggtcttcgctggggttcctgactcggaacttcgccagttcagggcgtcgatgtaccacgtggaggcccgcatcgtcgatgctgccctccaagtgacagaccgggccctggaagccggggacctggggctggcccggtgggcgttgacccaagggctactggtgtctcccgatcatgaggacctggtcgccggttgtctgcgcaccgagtaccaggccggcaacatggacaaggtatccgaactggtcgatcacctgtcggctaccgcacgacgcctgggcgtcgatttgagcgccgacaccacccggatcatcgactccgttattacccatacacgcaggagagcatcatgatctcttctgcactcagctctgtcaggaaggttcctatgcaccattatcgtcttggtatcggcactgccctcatcgcggtagcagccgtggccggctgtcgctcaacagactcgacacccacaccacctccatcccgtgtctccgccacgacatcagcgagctctaccctcagcccgaccccgtcagccggagcgatcagtgccgccgacgccgaaaacatctaccgcaccgtccaagctaacaagatcgcactgtacaaaaagggtggcctggcacccggggaacccgcacccgcgacactgtcgaactacgccaccggccaggctctcaccgactacatgacctacatgcaccaaatctcggggcagggcatcaaaatcacatcggggaactcctcggttaccgcggtgcgggagaaaaagggtgataccacctaccccgaagccgctatcgccttggaatcgtgcgaagacgacagttcgattcgtaccgtggaccgccacggaaaggctgatcatggacgcattttccatgtcgacagttggtatgcccgcgataagaagggcaccgtcaagatgatcgcattcaactcaacggaggtccccacatgcgacgtcaagtaatcaccgcggccgtactgggcctggccctggccaccacctccctgcccgccctcgcaggcggcggcgacttgaacggcagtgtggacacggatggtcctggttacgatgtgcgtactgaggtggattaccatcacaccaccggtggtgcgggtgggggtgccacgacagggggccatcatgggggcaaaacccacggtgatggtgaaggtgaggctattgatgggcgttctcgcgccgatgccgaagccgaactagacgaagccgaccgtaaccaggacttgacttgtgatgtcttgctcccaccggcgccgaataccccagccggccaggaatgggcgaaagaatgcaatcccccagcgaaaaaggggcagaaggccaccccgaagcccgatccggtgttagtgggccgtcacgcggccttgcagctcacccttcccggcgcggcccctcgtatcgatccgtcccccgaccttaaccggtggcactcggcagcagtgggccaggctttgtggttgtcggttgatgaccccaccgccactacgcagaaatcgatcacgtttatgggccaggttgtctctttgagcgccaaacgtaacggtttgtcgtttgatatgggtgatggtcatgtcgtgcactgtgatgccacgacgacatggacggagtcggtggaaccggggaccccctcacccacgtgcggttacacctaccaacaggcagccccggccgggggctataaggtcaccgcgatcacttcgtgggatgtgacctggtcggtactaggacacacgggcacagtgcatgttgagaaagccggtgggcagatgcttccggtcggcgagttggagtcagttgtcacccgccgatgaaccccgatagccccaccctctacgaggtattgggggttacccccgacgccaccgacacccagctcaagacggcatggcgcactgctgcgaaagcgacccaccccgatgccggcggcgacccccaggcgttcacggccgcccggcacgcctgggaggtgttgtctgatcctgcccggcgcaccgcctacgatgccgacctggcgggggaggatgatcccgacgacgaagccgccgacgccttcgacgttgatccgttcacggcatggccctggtgcgccccgtacatcgacgccacccccaccctgcgccacacctgccccggcacgatcaaggccatcgtggtcgccatcgccgggatcatggccggaatcggctggcaggaagcgctggaggccgtggtgtcgccgccggggtttctgggggcgtgctggatagtctcagtgccggttgtcgtcgcagtgacatggctggcagcg

SEQ ID NO: 277 - DNA, 1224 bp, Propionibacterium acnes
gacgccggccaccccaactactccgacccacacggtgaccccagctccggcctctgccggccactcgaccagcgacgagcacccaatccatacggataccgccacagcggacaaggccagcgacgaggacgccctgtccccaatccaggtgggtttgaccgccagcgtcggactggtgctggtcgccggactgatcaccaccctcaaccgccgctaccggacccggttcacccgccagccccgcggcaaggccatgaccctgcccagcccggacgcccaaactgccgagatagcgctgcgcagcaccggggcgactgacactctgacgatcacctgcctcgaccaggcgctccgcgcgatcggcgcatggtgccaccactgcgggcacccgctgccacccctgctggccgcccgcgtcgatgacgaccggatcgacctgctgctatcccaggcggcccccgaccatcccgaggcggtggagctggccgccgacggatcggtgtggaccctcaccgctgaccggatcgacgacctgctagcccacaccgatgacaaccaagcggctccgtggccgtctctggtcacactgggacgcgacgacgacggcgcccacatcctcatcgacttggaagccgcaggaaccttgcacctgatcgccgatgacgaccaggtcgacgcggccctcgccgcgatcgccgtggaactggccacctgtgactggtccgacgaagtcaacgtcaccctcgtcggccaggtgtgcccgggcctagaagacgcactagagtctccgaccctgacccgcgccaccgacgtcgacgccctcctcaccaccctagaagctcgcgccgacgaccagcgacacatcctcaccgaaggaaaccccctcgccgctcaccgagccgaccccgccatctccgacgggttcgacgccgaagtgatcctcctcgacaccgaactcaccgaagaccaccgcaaccgcctcgccagcctcgtcgaggctcttccccgggtgtcggtggccgcggtaacaaccagccccaccagcccagacgaatggtccctcaccctgacaggtgacccactagccgccgacgtggctcccctcggctggcacatccacccccaaaccctctcccccgacctgtacaaccgcgtggttgaactactcgccaactccgcagccgcagactacgaacccgccgactggtgggaccatgacgccga

SEQ ID NO: 278 - DNA, 3861 bp, Propionibacterium acnes
gctgagaaaaattttgggtccgccctgcatatcggggcctcttcataccttcaaaagtgtgaagggaatacagactcttcgactggaattaaaatggtatatggcgtgtccggtccgcacccagctccacgatgcgccatagaggagccataacttcaccaatcgtatacgatatgagtgtaggtgagcatctaccggtggccgacagtcagatacaagcatgggcggatgaagcagaagctgattatgacctcagcatgcttccgccgtctcgacgtggtcgcccaccggtggggaggggcccgggcactgtggtccctgtgcgcttcgacgcggacactctcaaggcgttgtcacaacgagcccatgacgaaggattgaccacgcgttctgacgcgatccgtgctgcggttaaccagtggctcggcctcggctcgtaaacattatcggcgcgacaaccttactgatgacgctgttggttacgccgtagagcacatcttgtactcgtgggcgctcgacgatgccgatgatcctcgttgctggatgatgattcggtgttgacccagctggcctcctcatggagctagttatcctcatctacgacgatggctatgaactcctgatccacgccatgaaagcccgccctcagtatctgagctacttcgctatctagtgttgttgggcgagttgaactcaacttttctccgacgcaagcgccaataaaaggctgatccatccgaataccaccaaacacggctgaagtgtggaacagattcagcaagacagggtgcggtgctcgggtgcgttggggagatgaggatattcaggcttctggcgggatgtggcttgatgacgtccaggatcaccggttcggttttgaaggtgccttgcattaatgtcgacagggtcgtacgactcgaggattggatcgaccagcccgttgcgtctgaagaacttcatccaccccggtggagctccggccgcgtactggtgcaacggatcattagcatgggtagcgtgagtatgccttcgatcgtggtcagtgctgtcatcatccaagattctgacgggcggcttctcactatccgtaaacgaggcaccgaggcattcatgctgccaggcggcaagccggagcccggcgaggactcgcgtcaggcagtagtccgggaagtgcacgaagagctcggcgtcgcattgtcttccgacgacctgcgtcgggtgggagtgttcaccacgcgagcagcgaatgaggccggccatcaggtggtggcgacgattttcacccacaccccggttgcggtgagtgagccagctgctgagatcgagcagattcgttggctcgattggagtgtcgacgccctgcctgacgacctggccccgctgctggtcgaggcagtcatcccgtggctgcggcgccgtatccggtcggtcgctgtattcacgggtgcgaaggatggaaccgaccctcattatcgtgtcgaagcaaccgccttgggccggggtctcgcacacgccgggatcaccctggtttatggcggcgggaagggcggggtgatgggtgctgttgctgatgcggccctcgctgctggcggcgctgtgatcggagtgatgccgcagcacttggtggacggggagatcgcccatcctagtctgactcacctcgaggtagtgcggactatgcatgagcgcaagcagcggatgagtgacctagctgacgcgttcgtcgcgctacccggcggcggcggaacccttgacgagctattcgaagcatggacatggcagcagctcggtgtacacagcaaacccgtggccttgtacgactcgaccttctgggcaccgctgaccgcgctactcaaccacatgaccatcgaaggcttcatccgccctgaggaccgcgcctcgctcgtgatcgccgataccatacatcagctgatggccgatcttgagggatggaccccaccaccaccgaagtggcgctcgtgacatagaacaaatgattctgactatggctcattgacatctgcgcagcggctactagctccattgacttcaaatcgggccttggccgaggctcggttcaggtggcccggaatggatccccacaaattgaatgctcatgatcgaggtgatgaacgcccactctattgtcctacgcccggttgtatccagcgagcaattgaaggtgctgcgcctgttggtcgaccaggccgagccactcactattgacgggaaagtcctgttcgagacctgggacgggctgcaggcagcccgtcctcacagctgagaaaaaattttggggccgttccgcacatcccggtctgtacccacaccttcaagggtgtgaagggaataaaaacacacctaacaacaactttgtttcatgatttggcgcgtcggaccctttctgaccgatgtcgtgcgcaacaatggacccatgagttcgcctaccaagatgcgccggaagggaacacgcggcccgaaacctcgcagcgacgaggagctaacggctgtgatgtgccgcatcccagagtcagtggccgaacgtgtcagcgatatggcttgggagctgaggctctcccgatccgatcttgtgggctggtcggccctctatgcactcaactcgatgctcagacagcgcggagaggacacgattccggttccggagtatctggacaaggccgtgctcactgcgttgtatcccgatgggttgcccttcgacgaggacaacgaggagccgggcgagaatgccgggcaggaggagcttgcgatgactggatgagcccgaacatggttgaaggccgccccgccaggcgaccttcaatcaatggtttcggttgtcagctgcagccacccttgccaggtgctgtggttcttctccagaggaggagggaccgccatgaagaccaagaagacctagaagatccaaaagaaccggtttcagcttttgcttcggtcttcatggtagctgatagcccgcgtcattggaagtgcgacgacgccgatcctcatcggtatcgcaccctgaaacagggtgttgaacatgaagggttgaccgctatgtcaagccatgagacgccctcccggagggcgtcatgaccgctttaattcaagctctgccgacagctgaactgtctgctggacctggtgctagcagtccagctagaccctctgctgagggcttcatcaagattcatcacgacctcattagtgcgggcgtgtcgggtaacgcgatggcgttgttcgtcgcgttacgtaaccagcccggctgtgatcagtggacccgtcactcgtacctgcggctagcccaatggtgcggctgggatgggctgtcggaggcggcgggctgtaagcgggtgcagcgggccgctgctgagctcgctagcggtggttggctggaatcgcgggtcggccatgatcgtcgcaccgctaagacgctggtgtggcatcggttgaccagccccgacaccgaccgctgggagcaattgccgcggattgtgtgggcgaggatctgccagatcgccggggagacgtcgggagagtgggtgaggcattggctggtgtggcggatgctggccggtcgtactggtgtggctcaggcccctacgtccatcgtggcccggttcctgggctgttcttcgcgccaggtctctcatatccgtggggctctcgttgatgccggtctgctcggctgtgacgaggtgtcgggggcggcgagccgggtgtggttcccctcgatggccgaggagtgtgcagcggatcgtgaggtggtcgatggggccgtcgtcggtgctgaggtgggctctggtgaaggtgtcgaggagggcggggaacccctgtcgattttgtccacccacccctgtc

SEQ ID NO: 279 - DNA, 3714 bp, Propionibacterium acnes
cgattttgtccacccacccctgtcgattttgtccgccaagtattagacaaaccattagacagtgaattagaccctgggtcgcgtcagcgtgttagctcaccaacgcgcgcgcgcgcggcggccgagccgccgaagccaaagaaacccataccaccaacgcctgaaccagcagcccccgcttcagacagtcctgtgtcagcgcacgctgatgaggctgccgagttggcgtggcggttcgtggggtggtgtcctcagctggtaggggcaccgaagaaggtgcgtggccagctccgtcagctggtcgctgccgagatccgccggaatccgggctggctggatgcgccagcgttggaggttgttgcccagcgggtacgtgctgaaggtgcgctgggggtccagcactgcgagattgtgcgagccgagctgcacggggtgatcgccgaccagaaggccgcccccgcccgccccgacgccctgcacgcgcgggagcccaagtggtgggacgacgtgtactacgaaggaaacacaaccgtgtggtacgactctgacgaaaccagtgacgacgacgaggcgtggaaccggtcgcaggtatgtcatgttgctgagcgtgacgacatggctggcgggattgctaccaacctgctggcctcccacgctgatgatccgatggcctggctgactcgccgtcaaaccatgctgatggctcgtttcccccacgcccagaacgaggtcatcgcgatgtgccacatcgtgcgcaccgccctggaggccgacatggccgccggaacccggtgggaggactgatgagggtctcccggcgcgccctcatggccgtggcccgtgccgacgctgccgcagcagaccatgccaccggccgatgggtggccacagccaacgccaccgtcgcccggctgaccggactgtgcgaacgcaccgtccaatacgcccgcgccaccctggtccacctgggcctgtgccgcgtcgtggccaccggccgctacctcaccgccgacgagcggcgcacggctgctcgcacccatggcggccgccagatgcgcgccgcctccacccgcgtcctcaccatgtcctgcgcaatcgtttgcgccctaccccgaaggggtcaccactacaggaaagttaagttcctagatggtcaccaacgcacgcgcaggcgcgtgcgaaggccagcaacaccagagaagaaacccctgtggctgcaaaaactcgcagccctcctcgaccagcacctgccctggctggtgagaaaccatcacatcggccgactgtgccacgccctcaccgccctgggcatcgacgaacactggcaacccgcagacctcgacgccctcctcgacgccatgaaccgcaggaaccgtcgcctcggcctcgacgtgccatgcgccgacgaccagcacaaccccttgggactgttcatccaccaggcccgagacaccctcacccacgacaacccccatgaacgccgcctggcccgcgaacaccaccgcgcccaactcatcgacgaccaactccgccgccgcgcagaaaccgccacctgcgcagcccgcctcgcagccgagcacgccgaccccgactaccagacccgccgtcgtgaacgcagggaaaccctgcgagccacactcagggccgcccagcagcatgtcaggacacactgatacccgctcatacacacaccatgaaacacgacaagccacctgacagtatcagctgcaagacgcatgacaacatagaaggacatgatgaaatacacatagacacaaccccgcacagcagtttcgcaacaaatcatgatagtctcatggcagtatcgcttgatacacacatagcatcactcccacataggcagttatgctgatatactcctactaggttatccgtccaacatgctgagtgggttcctgtacagcatgaaaggagcatggcatgatatgggccgttctcaactgcaagggtggtgtcggcaagacgaccagtgccctcctgctggcggcagccgccgccaagcagggccacaccaccctggtggccgacgctgacccccagggcaccgcatcccagtggtcagccctggcaaccaaaaacgacgaacccctgcccttcccggtgcaagcggtcaacatcgccaccatggaggcactgcccaccaccgacgcccatgatctcatcctcgttgacacacccccctcggcaggcgatctgatgttccaggcatgccgcatcgccgacctcatcatcatccccaccgccacctccggacccgacatctcccgaacatgggtcaccatggacgccacacaaggcacaccacgcgcgatcctcctcacccaaaccgaacacaaccgtgtcgtctaccgccaagctcgcactgccctcgccgccgacgacaccgtcgttctcctggaccacgacatcccccgccgtgaatccatccgcacagcatggggcaccaaccccccagacgacgtcatcacctactacctgcccgtcctcaacgaactcatggaggccctgtcatgaccaccaagaaaaccgacccattcgcccgccagaaagcagcagaagaccgcgcccaccaactccaagacgaagcccaacgccacgcccaccccaaacgcgtcatcggccccaccgcacgattccagttcgtcctgccagccgacgtgctcaccggcctcaaacacctcgccctcacccgcggcaccaccgcccgccaactcaccctcgacgccctcgacaccgcctacggcctcgacaccctcgccaacagcgggaagaaaacccacccatgacccgtgggtccccctgccaccaccccctcgacggcaactgtgtgcgagccacaggcccgcacacaggcggcagcccagtgccgtccccgccaggaaaggaactgaacttttctggagtgctggctccctatcaccccttatggtgctatcagatccagtagcgccagcccgagaggaaacccatgagctacatcgtccgcaccggaaatctagccggcacccccgagctgcgcgaggggtagccgacacggcggaccgtgcccctgacagtaagcggcactactggagacatcaccatgaccgctcagatcctcgccccgtgcaaccagaaggctgccgtcatcgaaggagccctgccatgaaccaacctaccccccacaaggccgacgagtcacagacgagcaacaccacgaggaagtggcggcacaaggtgtcgttctaccaagacccggccgacaccgaccgagtccgcggagcgatcctccacaccatgacaaccgaaggcaaccggaacctgagccagttcgtcaacgatgccgtcatggccaaggtgaccgaactggaagcaaaatacaaccacggcgagccattccccgccgtgggagcccgaggactccccccagggcggcgcagtcgccaacagataagagggcggggaccaccaatagcagtcgatttcggatctagatcgggtagacaggacccatgatgaatttcatatcctccctgctctcggccatcctgaccctctttgcgatggtagccgtggcgataggagtggtgaacattgtgccgggaatatgcgccatcatcggtgcacggaaatacggcgaccaggaccgtgtgcgggcaggacaacgaaagatccttcttggtgctatcgccttggtggtagcagtaggcattc

SEQ ID NO: 280 - DNA, 3907 bp, Propionibacterium acnes
ttggtattggtaggcgatggtgtcaccggttttgttgcggatgacgtcgaagccttcgatgtcggaggggatgtcgtcggcgtcgtagacgacggtggtggtgacggggttggaggccgacatttggccgatggtcacgcgcagcatgtttttcaacgcggaggtgaggattgtcgtggcggtggggttcttgtctgcccagcgtttctcggcgatgtcgatcatgtcttggatggttttgacccatcctcggatgggatcgactttggtcagtttgatccctccaaggaactcgatgggcttagtaacgggcccgtcaggaccgaattcggtgtcccagccttcgtcgatggctagtttcagttcggcggcgtcaacccatgtttcgtgggtggtgccgggcacgttgggccaaaaccatcctgctcgtcctttggtgcgtttgaccggtagtaggccgatgtcgtcccaccaggatggcacggtgaagcggatgtggtagcgggccgggtgccaggggttgttggtgaacaggtcgtgagcttcggtggcgctgagcagagtggcgggtgcggcaccgatctctccggtcactgatccggcatacatgaatcggccgtcgatgtacacgaagttagggatagggccggcaggcacggtggggcgccaaccttgttcgcggtcctcggggttgccgtcgtcgacgcatagttcgtagcggtgctgaggggaggtgtgttggatgagtgcgcccagttcggggtccatcggctccatgcgataggactcgggggtccgtagcttccagaggttgattccttctgctccggggcggtccatgagggcccagtcgcggtcgattctggtggcgatgatgtgggttaattcgcgccatgcccagcgggcctggattggggtgagggtctggccagggaaccattcatcagcgaccagaatgtcgaggttgcggtcggtttctttgtgggtgaaccggcctcgggcgggccgcccggacagcatgaacaggccccgcacgtgccagtcctggttgaactcgcgggtgtgagcgggggtgtcaggcagcagccaggattgaggctggtcggggatgttaccgcagacgatcaggcgtcgggcgttgtggtgtagcgcggttgttagcaggtctgacagggtcgcgtgcttggtgcgccgcccccctagcactggcaggatctcgtttccggccgcgtcgactccccgggcggtgtcgatgtctagccacactgtttcggggtcggggggccgatgtggggcgggacggcgctgctcctggtcgtctctcatggtttcctcctttgggccagggagcggccggcgtcgagggcgttcatgcgctcgcgttgttcttcgcgtagttggtagacccggcctcgtgacactcctgctgcctcggcgatggtggtggccggcaggtggccgatggcggcagcgtcggcaaggacgtcacgccaggccaggtcaatggttcccagctgggctagagcttcgtcgcggcggcgggtggcatcagccactacggaggcccaccctgtggggtggatggtcttgacgacgattcggttgtggcggatggggccccatgcatcagcggggacttgccagccgtgattggcggcggactcggtgatcttgaggcgtcgctcaggtgcgcgggtgcgggcagtgacgtcggtgttccaggtctggactggtacccacgtcccctctcggatgcgttcgatgacgcacgtggtgacctcgtcggtgactgtgatgaccagacgataatctttcccgtctggggtggttcggtagctgggcatgtcaccctcccctatctgtcaaatgagctagacacagtgtctatttaatttgacgcaaagtcaagtgcattagacgcctttgtgtggatccgccccaccagacaaacactcgcgcctcatgacccgccgcgaagccttaacgaaaccaaaccgcttatagaaccgctccgcagcgctccccgagggctttagctccaaggtaagaccttgctcgtcggcccattggcagacttgtgtgaggatctgtgagccgtagccctgatttcggggggcggcatgcacgcacatcagcatgtgaccatgacggcgggtcggcgggctgacataagccccaccacgccagtccggtgtgatctgccaacttcgccatgccgcagcgcgccagcggcgggcctcggtagccaccatgatcaccatgatgatggacagggttacgacgccgactatggtcagctcactccagccaggccagttcccggagatgatccagcctcccagcgcccagatgatcatggcttccacgcccgccgcaatcgggacgagtggggcagtacggatgcggcctgccatgatctcggtgatctcgctgcgatgccatgacaaggagaattcccacgactcttgaatcatgctgatgtgtgaacggcttcctcggcttcgccctgccatagcttctctagacggcgctcggctagctcgtcggggcacggcgacagcctgccgcactcggagcagaccccgaagtggcgcgagagagtgatgaccggctcatcgggagcatgaaccgattcaacgaccgggtgctgctcatcggtgagtcctgaggcgtgaccaatctcggctagacggaggtgaaccataccgtcgtagtagtcgaggccttcaacgtggaacgggtaggagccgtccgcggtgtggcctgcaaccaggtccccgacttccagctgactggcggtcatggttcgcaccggcggcagcggggtccgggtcgcgttgatcctcatggtctctccttgcttctgcgccttcatagatgaaggtgccacagccggggttgatgtgcggaaccacagccactttttcaataaatccatcaccacggtctcaccccttcccaaatgtgtaaaccgtggtttacgctttaaggcatgatcgaacacacaccgacacccgccgcgcctcgcgtggccatcatttcccctagcgggccaccacggttcttggccgagcctcccagcgccgcgctgcgacgccatggtcggacccgcatgaggtcccttcccctatcccctcacattcgcgcctgggtctccaccagcggccgcaaacccaatcccgtgactactgctttgatctggatgcacaccggggccctgcttttggtgtgggacatcgccgttttgaccggccccgccctcggccactgcgtatgccctctcagtaatagcgccgagctgactgcccggcgctggctcgaccaggtcgccgacaatcccggcttcctcaacacccttaccgaggctgcccgcatcaccgatgaatggcgtcacgcaacgcctccgcacattcaagccccttaccggacccttcatcagtgaacggaggtcatgcatgactagcaatattgaatggggccacaatcccgacggccgcgccgaggctcctctttaccgagcctgggccaagatgctcgtgcgcgcctccgggctaccctggcgtatcgtcgccgccctagccgggatctcccctacttccatgcaccaacttctgttcggccgcaacggtcgacccgtggaatggatcggctccgatgatgctcgcgccctgatggatatcggcatcgatgatctcgcctcagcgtccaccgaccgtatcccggcccgcgaatcccgcgagctgttggtagccctgcacaccctcggctggaccgatgagcatctaagccgctggctgaccagttccgacctcgacctgaccaccgcccccaaagccctctacgtcactcgactatccgccgcccgcatccaggccacttacgacctgctcgtcagccaacccgtccg

SEQ ID NO: 281 - DNA, 2174 bp, Propionibacterium acnes
ccccaatgcccccacaacgatcagcacaccaacagcgatcatcaggtgggcagcactaactgatcccaacgaaccaagatcaaacaagccctgcccgggagcgccgagcagtccgtgggcgcgaagccatgctccgagattgccaataatcttggggaccatcttgttcagtagggctatccctccgatgccgacaacgaggaagacgaggatttcttcgcctgcgttgtttcttcctgtgtttgcggtcatgctgccttctcggggtggatggccagccagctgatgaggttgtcggtgatctgccctgagatttggatcagttcgtcttgcccggcctgccatgcccgcgatgtgccggccagcaatgatgctgggacccctactgcgcggccacgggatgcaacctcagccaaggcggcgcgtaactcctcgacggtgctttcgatgtaccaactgccgtcagtactagtctcagcggcatcggtggtagcgataagagcatcggtgaggtcgtcgacggcgcggtccagatcagcgatgtccggtagggctacaggagtcatggtgtgtcttccttctagggtgccttcactggtgaagggtccctagccccggccgatgtgcggtgctgtgggaaaaatgcttcccattggtccgtcttagttaggaaacttggcctaagtgctgtcgagggtcgcgtgttcgtgaccggttcgaagacactgccgccttgccttcttgcccgtggcgcttccgagatggggtcagtgggcgatggctaggccgacgagggcgccgctgcacaggctgggtgcccaggggaggaatcgggtggtgtggtgtcggaaccggtcgattagggcatatagggcgatcagggtgaggccggctatgacagtgacctggatcgtgtcgatgccggttgctgcggccggggctgcccacagtggtgtgatgcgcacgtcggagaagccgaagccgcctcgggagatgagccaggcgatcatccacgccgcggagatgacgacagtagcgatagcagcacgtatcgccgcagtatggtccgagagggcggtaacgactacagccccgatccatccggcccatccggtccacgctaggactgccggtatccatgtggtgatggcgtcaatgacggcaacccatgccccgatggtggctagcagggcccacgtcggccacgtgggtgctggggcccatgctgtggcggtgatcatggtgagtgctgctgcgctacagaccgcgatcaagcttcggaggctgtaggtgtcgcggtaggcgatcttgtcgggattggcggtgggtggttcgggcaggatgtgggtgagggcaggccatcctgcgaccgcaatagccgcgacggcgaccacccacacgatctgttgcatgggtctcatcatggcccatcatcgatgagtatgggtggccgacatggggtcactcgtagaggggatcgaggggtgtgcgggcgagcatggcttcctgtgtgccgagcatgagggtgccagagtcgtcgccggccgattcccagtcgacgatgatctgcccgctgtcgaagctggattcggtgatggtcacccattctccgtcgatattgatgagcaccccagcggccagctctgtggcagcaaccgggtgaggtgggttgtagaagcggtcgatgtcgcgggcagggtcgtcgggttcttcggttacctcgggtggggtcgatctggctgtctcggtgtcgtcggccaggtcggctcccaggatgcgttcccattcggggctggttttcttgcccgctgaggccatcgtctcgtcgatctgttcgtcagtgggccacacaaatttctttttggtccaggtcgtggtgtcgggtcgcagctgatccagcagttccaggtcttgcggggagtgggccttgcgggggtcgggggtgtagaagaattggacttccttaggggctgattcgccggataggtaggtgccgcggccgcgtttgccgaacgggattcccacgccgacgtgttcggagccgaacatcatgcgggctccgtcagcagacaggggtccggtggcggcacgcccggagaagttgtctcggatttcgccgcccaggaactcggcgtcggggcgttgggtccccagatcgacgtggatacggcagg

SEQ ID NO: 282 - DNA, 1677 bp, Propionibacterium acnes
ccccctcttctgggtggtggtccggggcgtcaccgccccggaccagttgggtagtcatctcagttgaaataagcgattagtgatacgcccctcatgctttccggtgctgtcatgagcgtctgacaacagcgacacctcggggcagccgacggacagtcctctggctgccgctctgatcccatgcccacggcacgaaggtgtcggacagctcggtctcgtcatgtgcccaaatagcgtcgtgggcctgtcgccaagcttctcgggagccccacacgggcacgaccgggccacaccggtgtcctggtctccagtgtcgcgacactgtcgatttcggtacgtgcaatgcggcggcggtttgacggatcgacatcccagactcccgcgcgtcccagatcgccatgtggagagtatttgcctccagtgcggccgccacacttgcacgctctcgcgcacgctcgaatgcccgcctagtgctctcaaatgtcgtcacgacgcctccccctgaaaatactcagggtgtcccacggtgggacaccctgagtatttcataccccaactcgcctcaccacacgtcgacctcgacaccgatcaagcgacccgtatcagcgacattgccgtaccgctgccccgcctggtcctccagccacgacaacgcatcccgaaacagcccgacgtcttccaaagctaaaccacagtcgtagccgcccttgtcccccaaccgcacaatctggcgctcccggtggcctccctcgtcgacctcgatccacagtttcgcgtgcatccgctggcctcggccctctgacaggatctcggtgagcaggtcggacgcctgccctcgcgcatcctcgttactgcgggggaattggagtatgtgggaggaacggtggtggggcaggtttgtgacctcgtgacgcagcaggttgcgcttgtgcatctgccgttcgagacgctcgggctgacctgttgacggggttgagccgtggcgccgcttcctcggcggggtctcgatccgttgctcttccggcggttcggcgtcaggttgtggtgcgcgatctcccctaggacgggggggctcgccacctatatccgagggacgatgagacggccttccacgcttgctgcgcactttcgcagcccgccccttgcggtcacatcgacgcggcggcggagtgacgtcctcaccgcgcgctaactgcgtcaacgccgccaccaggttggtgcccggtttcagccctttcagcacgaaccgcaccaggcgggggtctcggccgattcgtcgggcaatctcggcttggctccacccttcggctaacagggtgcgcaacaagtcttgggcccggttatcacgctcagtcactggtcgcctcctcggggagtcctgcctgctcggcctgctctgatagagcagcccgttccgatccggtctggggcgctttcaggggaccgggtaggacacctttgacacgcagtcgcccgtccttgccgtcgtcgccgcccccctgggccacagggagcgcccgggggggcacgttgctggtgtagatggcgtcgccgtggatagccagcagggtgcgggagttcatgcgtagtgctcctcccttggttgtggcgttttttccggtggtggggtcggcgatgggtgtgttgagggtgcgtacgcgggacagggcccagata

SEQ ID NO: 283 - DNA, 3558 bp, Propionibacterium acnes
aaccgtcatctggcgtggagtagcgagctgatgcaggaaggcaatttgtacggccttcccgaggaagacccgttgtggggcgaggccgtggagctggtagcgggacttatcccctctgtgcgggcgatgtggtcgcacgatgggcagaccgtgactgtgtcggctggccggcgggtggcgacactggggatgccgatgcggggatggcgtggtatcgagatgcgcggctggaatccagtgggcgccgatacgtggtggatcgttgaccaggtgggtagttggctggtcgatcaggatgagccgatggtcgttgacgggagggtgctccatgaggcgtgggaacggtcgcagatggtccgttcaggccgctgagaaaaaatttaggtccgccctgcatatcggggcctcttcataccttcaaaagtgtgaagggaatacagactcttcgactggaattaaaatggtatatggcgtgtccggtccgcacccagctccacgatgcgccataggggagccataacttcaccaatcgtatacgatatgagtgtaggtgagcatctaccggtggccgacagtcagatacaagcatgggcggatgaagcagaagctgattatgacctcagcatgcttccgccgtctcgacgtggtcgcccaccggtggggaggggcccgggcactgtggtccctgtgcgcttcgacgcggacactctcaaggcgttgtcacaacgagcccctgacgaaggattgaccacgcgttctgacgcgatccgtgctgcggttaaccagtggctcggcctcggctcgtaaacattatcggcgcgacaaccttactgatgacgctgttggttacgccgtagagcacatcttgtactcgtgggcgctcgacgatgctgatgatcctcgttgctggatgatgattcggtgttgacccagctggcctcctcatggagctagttatcctcatctacgacgatggctatgaactcctgatccacgccatgaaagcccgccctcagtatctgagctacttcgctatctagtgttgttgggcgagttgaactcaacttttctccgacgcaagcgccaataaaaggctgatccatccgaataccaccaaacacggctgacgtgtggaacagattcagcaagacagggtgcggtgctcgggtgcgttggggagatgaggatattcaggcttctggcgggatgtggcttgatgacgtccaggatcaccggttcggttttgaaggtgccttgcattaatgtcgacagggtcgtacgactcgaggactggatcgaccagcccgttgcgtctgaagaacttcatccaccccggtggagctccggccgcgtactggtgcaacggatcattagcatgggtagcgtgagtatgccttcgatcgtggtcagtgctgtcatcatccaaggttctgacgggcggcttctcactgtccgtaaacgaggcaccgaggcattcatgctgccaggcggcaagccggagcccggcgaggactcgcgtcaggcagtagtccgggaagtgcacgaagagctcggcgtcgcattgtcttccgacgacctgcgtcgggtgggagtgttcaccacgcgagcagcgaatgaggccggccatcaggtggtggcgacgattttcacccacaccccggttgcggtgagtgagccagctgctgagatcgagcagattcgttggctcgattggagtgtcgacgccctgcctgatgacctggccccgctgctggtcgaggcagtcatcccgtggctgcggcgccgtatccggtcggtcgctgtattcacgggtgcgaaggatggaaccgaccctcattatcgtgtcgaagcaaccgccttgggccggggtctcgcacacgccgggatcaccctggtttatggcggcgggaaggtcgggatgatgggtgctgttgctgatgcggccctcgctgctggcggcgctgtgatcggagtgatgccgcagcacttggtggacggggagatcgcccatcctagtctgactcacctcgaggtagtgcggactatgcatgagcgcaagcagcggatgagtgacctagctgacgcgttcgtcgcgctacccggcggcggcggaacccttgacgagctattcgaagcatggacatggcagcagctcggtgtacacagcaaacccgtggccttgtacgactcgaccttctgggcaccgctgaccgcgctactcaaccacatgaccatcgaaggcttcatccgccctgaggaccgcgcctcgctcgtgatcgccgataccatacatcagctgatggccgatcttgagggatggaccccaccaccaccgaagtggcgctcgtgacatagaacaaatgattctgactatggctcattgacatctgcgcagcggctactagctccattgacttcaaatcgggccttggccgaggctcggttcaggtggcccggaatggatccccacaaattgaatgctcatgatcgaggtgatgaacgcccactctattgtcctacgcccggttgtatccagcgagcaattgaaggtgctgcgcctgttggtcgaccaggccgagccactcatcatcgacgggcgcatcttgtacgaggcatgggacaggctgcaaacagcccgtccggcccgctagaaaaaatttttagggcccgctccgcacatcccggtctgtacccacaccttcaagggtgtgaagggaataaaaacacacctaacaacaactttgtttcatgatttggcgcgtcggaccctttctgaccgatgtcgtgcgcaacaatggacccatgagttcgcctaccaagatgcgccggaaggggacacgcggcccgaaacctcgcagcgacgaggagctaacggctgtgatgttccgcgtcccagagtcagtggccgaacgtgtcagcgatatggcttgggagctgaggctctcccgatccgatcttgtgggctggtcggccctctatgcactcaactcgatgctcagacagcgcggagaggacacgattccggttccggagtatctggacaaggccgtgctcgctgcgttgtatcccgatgggttgcccttcgacgaggacaccgaggagccgggcgagaatgccgggcaggaggagcttgcgatgactggatgagcccgaacatggttgaaggccgccccgccaggcgaccttcaatcaatggtttcggttgtcagctgcagccacccttgccaggtgctgtggttcttctccagaggaggagggaccgccatgaagacccagaagacctagaagatccaaaagaaccggtttcggctgttgcttcggtcttcatggtagctgatagcccgcgtcgttggaagtgcgacgacgccgatcctcatcggtatcgcaccctgttccagggtcgagaatgtgaaggattaacaaccatgacaagtcatgagacgccctcccggagggcgtcatgaccgctttaattcaagctctgccgacagctgaactgtctgctggacctggtgctagcagtccagctagaccctctgctgagggcttcatcaagat

SEQ ID NO: 284 - DNA, 3282 bp, Propionibacterium acnes
gagccagttatcctcatctacgacgatggctatgaactcctgatccacgccatgaaagcccgccctcagtatctgagctacttcgctatctagtgttgttgggcgagttgaactcaacttttctccgacgcaagcgccaataaaaggctgatccatccgaataccaccaaacacggctgaagtgtggaacagattcagcaagacagggtgcggtgctcgggtgcgttggggagatgaggatattcaggcttctggcgggatgtggcttgatgacgtccaggatcaccggttcggttttgaaggtgccttgcattaatgtcgacagggtcgtacgactcgaggattggatcgaccagcccgttgcgtctgaagaacttcatccaccccggtggagctccggccgcgtactggtgcaacggatcattagcatgggtagcgtgagtatgccttcgatcgtggtcagtgctgtcatcatccaagattctgacgggcggcttctcactgtccgtaaacgaggcgccgaggcattcatgctgccaggcggcaagccggagcccggcgaggactcgcgtcaggcagtagtccgggaagtgcacgaagagctcggcgtcgcattgtcttccgacgacctgcgtcgggtgggagtgttcaccacgcgagcagcgaatgaggccggccatcaggtggtggcgacgattttcacccacaccccggttgcggtgagtgagccagctgctgagatcgagcagattcgttggctcgattggagtgtcgacgccctgcctgatgacctggccccgctgctggtcgaggcagtcatcccgtggctgcggcgccgtatccggtcggtcgctgtattcacgggtgcgaaggatggaaccgaccctcattatcgtgtcgaagcaaccgccttgggccggggtctcgcacacgccgggatcaccctggtttatggcggcgggaaggtcggggtgatgggtgctgttgctgatgcggccctcgctgctggcggcgctgtgatcggagtgatgccgcagcacttggtggacggggagatcgcccatcctagtctgactcacctcgaggtagtgcggactatgcatgagcgcaagcagcggatgagtgacctagctgacgcgttcgtcgcgctacccggcggcggcggaacccttgacgagctattcgaagcatggacatggcagcagctcggtgtacacagcaaacccgtggccttgtacgactcgaccttctgggcaccgctgaccgcgctactcaaccacatgaccatcgaaggcttcatccgccctgaggaccgcgcctcgctcgtgatcgccgataccatacatcagctgatggccgatcttgagggatggaccccaccaccaccgaagtggcgctcgtgacatagaacaaatgattctgactatggctcattgacatctgcgcagcggctactagctccattgacttcaaatcgggccttggccgaggctcggttcaggtggcccggaatggatccccacaaattgaatgctcatgatcgaggtgatgaacgcccactctattgtcctacgcccggttgtatccagcgagcaattgaaggtgctgcgcctgttggtcgaccaggccgagccactcatcatcgacgggcgcatcttgtacgaggcatgggacaggctgcaaacagcccgtccggcccgctagaaaaaatttttagggcccgctccgcacatcccggtctgtacccacaccttcaagggtgtgaagggaataaaaacacacctaacaacaactttgtttcatgatttggcgcgtcggaccctttctgaccgatgtcgtgcgcaacaatggacccatgagttcgcctaccaagacccgccggaaggggacacgcggcccgaaacctcgcagcgacgaggagctaacggctgtgatgttccgcgtcccagagtcagtggccgaacgtgtcagcgatatggcttgggagctgaggctctcccgatccgatcttgtgggctggtcggccctctatgcactcaactcgatgctcagacagcgcggagaggacacgattccggttccggagtatctggacaaggccgtgctcgctgcgttgtatcccgatgggttgcccttcgacgaggacaacgaggagccgggcgagaatgccgggcaggaggagcttgcgatgactggatgagcccgaacatggttgaaggccgccccgccaggcgaccttcaatcaatggtttcggttgtcagctgcagccacccttgccaggtgctgtggttcttctccagaggaggagggaccgccatgaagaccaagaagacctagaagatccaaaagaaccggtttcggctgttgcttcggtcttcatggtagctgatagcccgcgtcgttggaagtgcgacgacgccgatcctcatcggtatcgcaccctgaaacagggtgttgaacatgaagggttgaccgctatgtcaagccatgagacgccctcccggagggcgtcatgaccgctttaattcaagctctgccgacagctgaactgtctgctggacctggtgctagcagtccagctagaccctctgctgagggcttcatcaagattcatcacgacctcattagtgcgggcgtgtcgggtaacgcgatggcgttgttcgtcgcgttacgtaaccagcccggctgtgatcagtggacccgtcactcgtacctgcggctagcccaatggtgcggctgggatgggctgtcggaggcggcgggctgtaagcgggtgcagcgggccgctgctgagctcgctagcggtggttggctggaatcgcgggtcggccatgatcgtcgcaccgctaagacgctggtgtggcatcggttgaccagccccgacaccgaccgctgggagcaattgccgcggattgtgtgggcgaggatctgccagatcgccggagagacgtcgggagagtgggtgaggcattggctggtgtggcggatgctggccggtcgtactggtgtggctcaggcccctacgaccatcgtggcccggttcctgggctgttcttcgcgccaggtctcccatatccgtggggctctcgttgatgccggtctgctcggctgtgacgaggtgtcgggggcggcgagccgggtgtggttcccctcgatggccgaggagtgtgcagcggatcgtgaggtggtcgatggggccgtcgtcgatgctgaggtgggctctggtgaaggtgtcgaggagggcggggaacccctgtcgattttgtccacccacccctgtc

SEQ ID NO: 285 - DNA, 3093 bp, Propionibacterium acnes
gtcgagaatggccttgaggacgagggcttggattgtggtgtcattctgggctgccttgaccttcagtccaacgccgatgtcccgggggattctggtctgcaacttgaacaggtctgcctccttggttttgaacagtttggttgcagggttggcaacgggctgttcttggcgctggcgtccaaggttgcttttctttcgggcggtcatgacatcatctccaacagttcgtcggcaacatcggcgaagaaggcgatagtttccggctcaggggtacagccgtaggcgcgcttgatgacttgacgcttggggatgacgtgatcgaccaactgcgtctgggagtcgttggctagaaggtcgcgaccttccttgaacagggaggtattcggttcagctttggaaagcagcaccacgcgcggggttcctgcggcggcgtcgtgcgtctcccaggtgcgcgccatgtcgagcccggacgtgtcggtggggatgataaccagatcggcggcgcgaatggcggcggtgatgatgtcaccgttgcccggcggggtgtcaatgatgacaacttcttcgggtccggcgacgaggtgctggagcgtcgccttgttggccggttccacggggaaccccaaggggtcggcgttactcagtgtgcactcggcccaggatgatgctgacccttgagggtcggcatctttgacgcggaccatacggcccgtctcatggagagctgcagccagcaggatcgctgccgtggtcttaccgacgccacccttggcgttgataatgctccagatcatggtgacacctttcagtgaggatgcatatcagtttacctgcaaggagtaaagacggcaagcagttatgccgtttctgcggcaagccgtcttgcatccttggatgtatagatagttgtctacttatggttgtggatcgtggtgtctcgtaccaggatttagtgtgctcgctgatatgcacgactttcgggcggcctgatctggcggtggtgccactaacccaggagtctgatccgcaaggtgtcctcgactttgaggaaggggtctctgctttcgtgttgacctaaagtcaacggccctgggcgatcactgaatcctaatatctttgtatccttccctgattgcatcttagcatccttgaattcaaacagggatggagccatgctgttttgacgacatggatgcactggggtttggttgttgccgatgcggagcgtcaggcggcccgggacgccgccaccgccgacacgctgcgggagatcgtgggactgctgggccggggcggcgaggtcccgcccgccaagacggggcgtaagacgaccggcaggccggccccggcccgcaagtcgtcggccacgcagtaaaggcagggatccgtccctacgcagagagcggaggcagatcctgggggatccgactcttcggttccgtgatcttcccggagatcttcccggatcccccagggctcatcctgatacggggtccgccgacggaccccgtatcagtgggggcgctgccaccagtgatggcgggcgggtcggtcggcgtctaggccccgcccgatggtcgcctggtctacctcgcaggcccgtgctgttgccgaggccgagaacgtctgcccacttgttgccgattcagtcccctctccgtctgccatgtcgccaacctttcctatctggcgtgctcatggacatgcccgggcacgccctcgctgctcagaggcctgctcgttccacctctggccgcgaaccgtatttctgctgaccactcctcgtgcgtgaatatttgccagccttggccattcatatttggactactctgcaccagatatcggactgggaaacctcttgcacatctctaattgtcatctattcgttgggcgcgcgctgttagatcgtgatcataccaatcagaagacaaagcgacgcccttttgagcggcttttcgaacgattctagaccgcgctatatcagcatttctaccgcgcggccagagtgctacactaaattcctctctgcaatccttaagtccattctttacttcctcatccaatttctgcgacagcatttttatggaagcatcgcactctgactcatcatcaaatgcctcaattgcgtgcgttcgccattcacggcgcgtattatcgtagccgtaatgaagtattacccaccgatccacagaatcatcgttaggatctacaactgtcatgaatggcccaactctcgcgctggtgtattctcaattgcagttcagtgactttacttgaccagtcccggatttagtagacgtagacggagagtaccccgccgggaacttgactgacatcactgctgtaccgtactgctttcccgggtggcaaccatcgtaagcagcatttgccgtgacgtacctagtgctctttctctgagtgccggtaatcgccttatatggtacaggtgggtgaatcgtagccgttacggataccgatgacacgtttgcatcacatgaagctgtggcgacataattagttgtcccattgacatgatgagagtcgtggacatactgtcgaggatcgagagtgcaggttattgttgacgccgttgttctggtaccagctgctttcgagctctttgttgcagttacagtctgcggccctgaaggttttactgacgcgactgatgtgttcgcgtgttttgcggcagtgctttgatttggttgtgcttgtgtagcagttgctgatgtcgccagtgatgcccccattaccatagctgtgattatggcgtagtctttacgcttcattgcgcccccaaataagcatgttagtttgctattttgaataggatacgagacatcgccatgacttgtcaagggaagaagtaaaaagaatcgggggggtatcaagaaagatgtgctttcatcaggacgaaagcggatgggtccgttcgacttggtgacgaatgatccggccttgcgtcgcggagaccaggccggcgagtttgtcgagcagggccgccgtggcctcatcgtcgggcacatcactaaagggacgaacaaccatgacggctagggccagaaacgaccggaactgaatcgcatgtggacc

SEQ ID NO: 286 - DNA, 2920 bp, Propionibacterium acnes
acccttccagcccagcaccacccactacaccgacacgatccacgaagctgaaaccgaacctcccatccccgtccgaaacatcaacgaactcatcaaccccaccaaccatgcatgaacgcacgatcgcctaccggccagccttcctgcgcgacgtgaagcggctcaaaaacaagcactacaacatgaacacacactcaaatgggcggtaaggtcacgaagtcgacgtggctgcctcacggatggcttcggcgagctcttggggtcgactccacatgggccagtggccggttggcagatccatcgcggtgaagttggtcaggtgcgcgacggcgctgaacatcggattgcctgctgcggccagctcgaggacctggacgctgggaatggagcagcagatcaacgtggttagtacatcatggcgagcgctattggacagcgcgacccgtgcccgggccacttgcgcgggttcaggaaccgcccgtgcccggaaccggtcaaggtgctcgttgctgaggccctctaaactggcctgcttgccgagagtatcgaagtcaggaagtggcagctcagctgtttcctcaggtagatctggtgcgaaggcacctccatcgctcatgggaccggagtccacccagacgatccgatggaccaactctgggtgcctgtctacaactaggctcaccggcccgttcgcgccactgtgtcccaccaggaccgcatcgccgcccatctcgtccaggatggctgagatggcgtcagcttggtcgtcgagcgtgcgcgtagtgcgctgggtgtcctccggatcgagacctggcagcgtcagccccacggctcgactgccagcagtgttcaataactcgactacctcgtcccaagcccaggctccgagccagtaaccaggaacgaggacgataggccgatgctggtcaggtcgcgatgttgaagtcatggagacatagttgcacagtgcgcggacaagggagtggcactatttctggcatgaatttagatctgggtgtccggtgaggcgatcagaacgcctccatgtactgtccgagtgtctaggatgcagcggacacagtcgagcagctggctcacaagtttccaggtgtccttctgcccctatgagggaagtcggctgctctcgcaacctttgagggctgctctggggtcggaaccagttacagatcgttcaagttccgggaactaccgccggtcacgctgattgattcccgggcgatctcgcttctgacgacagtggtcggtgaccgagaggagtcctactctgaccccgctgctgcggtgagtaaatcacgggcgtcccggatccggccacccgtccaagtgccagccagcttgatcggctaggcatcgtcaaggagcgacgatgaggtgatgatgcgatgtgagcgcaccgcgaagtgaggtataaagaagccttcccgggcgcatgcgtcgcccaggaaggccaggttggcccctggacggctgaatggttgggcggatcaggctgtagcggagacgtgcagtacctcgtaggcgatggcgttggttgggctctggtctgcatcgtggctactgagttcgacgaggatgacggtccaggtggtgatgtcgacggcggtgacgcgggcgatggtggaatcagtggatgctgcaaggaagtcggcggttatgtcttcgatgcagtgggacggagcagtgctggtgggcaggggcacggtcttgacggtcaggcttcgggcagcagagtaatcggcggttccgttaacaagctggtggacggtccagtcctggatcgggtgccggccgaagtcgcgtacgatagccgagtaaccaagttcgccccagcagaactggcgcatcccctctatgtcgcgccagacgtagaagggcgcgtaggagttctggggtgcgcctttgaccttttcttggatgaggtaggccttgaactccagtccatggtagccgtccatgaggtgtccagtctggatgacgcggtcgcggatgatctgcatgtcatagtcggtgggcagggtgatctgatattgcatggcgtacatcagcggttctccttggtttcgtgggagtaggtcgtgggggtgacgggttcctgccaatcgatggttgacaagtcgtcggcggcttgttggtaggtaaggtggatcattggctgtttgagtgcagcgccatgccagtgtctctggccggcgtcgatccagatggattcgcccttggtcaggtgctggggtgcttgtccttcaatatggaccagggcaacgccgcccgtgacgtagaggccctgtcccttggggtgtgtgtgcctcagcggcaaacgtgacggcgtgggcggcacgcccggcgtcttccgtggcacgatcggccggatccatggcggcgcgcagctgctgttctgcagccaggcgtccaggtcacggcgggcagcatcgacacccagggcagcctcgacggcttcagggctacgacgctggccgggctggttgaccgcagaccactggtgccgggcgtcgtccagatcatggccggcggcgtcgatgagggcggtggtggcttcggcgcagcatcgcctgatccactccgaacgtgacaggccagctgtctcggcggcactgtcaatgcgcgccaggagagatttcatgggcgctcatctgtagcctccagataggcgttgatgtagcgcagagcctgatccgtcatgtcgatggcggctgcctcggcagacgacacaacgggctgtggatgataagaccacccaacatagacggcgaacatcaatttctcgacagctttcatgaggtccccggcggcaaccgcatccgcctcatcatccgaggagaaccacttcaggtctgaacggctgtacatagcccctaggtcctgatgtgggtcgaggtccttg

SEQ ID NO: 287 - DNA, 2918 bp, Propionibacterium acnes
acccttccagcccagcaccacccactacaccgacacgatccacgaagctgaaaccgaacctcccatccccgtccgaaacatcaacgaactcatcaaccccaccaaccatgcatgaacgcacgatcgcctaccggccagccttcctgcgcgacgtgaagcggctcaaaaacaagcactacaacatgaacacacactcaaatgggcggtaaggtcacgaagtcgacgtggctgcctcacggatggcttcggcgagctcttggggtcgactccacatgggccagtggccggttggcagatccatcgcggtgaagttggtcaggtgcgcgacggcgctgaacatcggattgcctgctgcggccagctcgaggacctggacgctgggaatggagcagcagatcaacgtggttagtacatcatggcgagcgctattggacagcgcgacccgtgcccgggccacttgcgcgggttcaggaaccgcccgtgcccggaaccggtcaaggtgctcgttgctgaggccctctaaactggcctgcttgccgagagtatcgaagtcaggaagtggcagctcagctgtttcctcaggtagatctggtgcgaaggcacctccatcgctcatgggaccggagtccacccagacgatccgatggaccaactctgggtgcctgtctacaactaggctcaccggcccgttcgcgccactgtgtcccaccaggaccgcatcgccgcccatctcgtccaggatggctgagatggcgtcagcttggtcgtcgagcgtgcgcgtagtgcgctgggtgtcctccggatcgagacctggcagcgtcagccccacggctcgactgccagcagtgttcaataactcgactacctcgtcccaagcccaggctccgagccagtaaccaggaacgaggacgataggccgatgctggtcaggtcgcgatgttgaagtcatggagacatagttgcacagtgcgcggacaagggagtggcactatttctggcatgaatttagatctgggtgtccggtgaggcgatcagaacgcctccatgtactgtccgagtgtctaggatgcagcggacacagtcgagcagctggctcacaagtttccaggtgtccttctgcccctatgagggaagtcggctgctctcgcaacctttgagggctgctctggggtcggaaccagttacagatcgttcaagttccgggaactaccgccggtcacgctgattgattcccgggcgatctcgcttctgacgacagtggtcggtgaccgagaggagtcctactctgaccccgctgctgcggtgagtaaatcacgggcgtcccggatccggccacccgtccaagtgccagccagcttgatcggctaggcatcgtcaaggagcgacgatgaggtgatgatgcgatgtgagcgcaccgcgaagtgaggtataaagaagccttcccgggcgcatgcgtcgcccaggaaggccaggttggcccctggacggctgaatggttgggcggatcaggctgtagcggagacgtgcagtacctcgtaggcgatggcgttggttgggctctggtctgcatcgtggctactgagttcgacgaggatgacggtccaggtggtgatgtcgacggcggtgacgcgggcgatggtggaatcagtggatgctgcaaggaagtcggcggttatgtcttcgatgcagtgggacggagcagtgctggtgggcaggggcacggtcttgacggtcaggcttcgggcagcagagtaatcggcggttccgttaacaagctggtggacggtccagtcctggatcgggtgccggccgaagtcgcgtacgatagccgagtaaccaagttcgccccagcagaactggcgcatcccctctatgtcgcgccagacgtagaagggcgcgtaggagttctggggtgcgcctttgaccttttcttggatgaggtaggccttgaactccagtccatggtagccgtccatgaggtgtccagtctggatgacgcggtcgcggatgatctgcatgtcatagtcggtgggcagggtgatctgatattgcatggcgtacatcagcggttctccttggtttcgtgggagtaggtcgtgggggtgacgggttcctgccaatcgatggttgacaagtcgtcggcggcttgttggtaggtaaggtggatcattggctgtttgagtgcagcgccatgccagtgtctctggccggcgtcgatccagatggattcgcccttggtcaggtgctggggtgcttgtccttcaatatggaccagggcaacgccgcccgtgacgtagaggccctgtcccttggggtgtgtgtgcctcagcggcaaacgtgacggcgtgggcggcacgcccggcgtcttccgtggcacgatcggccggatccatggcggcgcgcagctgctgttctgcagccaggcgtccaggtcacggcgggcagcatcgacacccagggcagcctcgacggcttcagggctacgacgctggccgggctggttgaccgcagaccactggtgccgggcgtcgtccagatcatggccggcggcgtcgatgagggcggtggtggcttcggcgcagcatcgcctgatccactccgaacgtgacaggccagctgtctcggcggcactgtcaatgcgcgccaggagagatttcatgggcgctcatctgtagcctccagataggcgttgatgtagcgcagagcctgatccgtcatgtcgatggcggctgcctcggcagacgacacaacgggctgtggatgataagaccacccaacatagacggcgaacatcaatttctcgacagctttcatgaggtccccggcggcaaccgcatccgcctcatcatccgaggagaaccacttcaggtctgaacggctgtacatagcccctaggtcctgatgtgggtcgaggtcct

SEQ ID NO: 288 - DNA, 2920 bp, Propionibacterium acnes
acccttccagcccagcaccacccactacaccgacacgatccacgaagctgaaaccgaacctcccatccccgtccgaaacatcaacgaactcatcaaccccaccaaccatgcatgaacgcacgatcgcctaccggccagccttcctgcgcgacgtgaagcggctcaaaaacaagcactacaacatgaacacacactcaaatgggcggtaaggtcacgaagtcgacgtggctgcctcacggatggcttcggcgagctcttggggtcgactccacatgggccagtggccggttggcagatccatcgcggtgaagttggtcaggtgcgcgacggcgctgaacatcggattgcctgctgcggccagctcgaggacctggacgctgggaatggagcagcagatcaacgtggttagtacatcatggcgagcgctattggacagcgcgacccgtgcccgggccacttgcgcgggttcaggaaccgcccgtgcccggaaccggtcaaggtgctcgttgctgaggccctctaaactggcctgcttgccgagagtatcgaagtcaggaagtggcagctcagctgtttcctcaggtagatctggtgcgaaggcacctccatcgctcatgggaccggagtccacccagacgatccgatggaccaactctgggtgcctgtctacaactaggctcaccggcccgttcgcgccactgtgtcccaccaggaccgcatcgccgcccatctcgtccaggatggctgagatggcgtcagcttggtcgtcgagcgtgcgcgtagtgcgctgggtgtcctccggatcgagacctggcagcgtcagccccacggctcgactgccagcagtgttcaataactcgactacctcgtcccaagcccaggctccgagccagtaaccaggaacgaggacgataggccgatgctggtcaggtcgcgatgttgaagtcatggagacatagttgcacagtgcgcggacgagggagtggcactatttctggcatgaatttagatctgggtgtccggtgaggcgatcagaacgcctccatgtactgtccgagtgtctaggatgcagcggacacagtcgagcagctggctcacaagtttccaggtgtccttctgcccctatgagggaagtcggctgctctcgcaacctttgagggctgctctggggtcggaaccagttacagatcgttcaagttccgggaactaccgccggtcacgctgattgattcccgggcgatctcgcttctgacgacagtggtcggtgaccgagaggagtcctactctgaccccgctgctgcggtgagtaaatcacgggcgtcccggatccggccacccgtccaagtgccagccagcttgatcggctaggcatcgtcaaggagcgacgatgaggtgatgatgcgatgtgagcgcaccgcgaagtgaggtataaagaagccttcccgggcgcatgcgtcgcccaggaaggccaggttggcccctggacggctgaatggttgggcggatcaggctgtagcggagacgtgcagtacctcgtaggcgatggcgttggttgggctctggtctgcatcgtggctactgagttcgacgaggatgacggtccaggtggtgatgtcgacggcggtgacgcgggcgatggtggaatcagtggatgctgcaaggaagtcggcggttatgtcttcgatgcagtgggacggagcagtgctggtgggcaggggcacggtcttgacggtcaggcttcgggcagcagagtaatcggcggttccgttaacaagctggtggacggtccagtcctggatcgggtgccggccgaagtcgcgtacgatagccgagtaaccaagttcgccccagcagaactggcgcatcccctctatgtcgcgccagacgtagaagggcgcgtaggagttctggggtgcgcctttgaccttttcttggatgaggtaggccttgaactccagtccatggtagccgtccatgaggtgtccagtctggatgacgcggtcgcggatgatctgcatgtcatagtcggtgggcagggtgatctgatattgcatggcgtacatcagcggttctccttggtttcgtgggagtaggtcgtgggggtgacgggttcctgccaatcgatggttgacaagtcgtcggcggcttgttggtaggtaaggtggatcattggctgtttgagtgcagcgccatgccagtgtctctggccggcgtcgatccagatggattcgcccttggtcaggtgctggggtgcttgtccttcaatatggaccagggcaacgccgcccgtgacgtagaggccctgtcccttggggtgtgtgtgcctcagcggcaaacgtgacggcgtgggcggcacgcccggcgtcttccgtggcacgatcggccggatccatggcggcgcgcagctgctgttctgcagccaggcgtccaggtcacggcgggcagcatcgacacccagggcagcctcgacggcttcagggctacgacgctggccgggctggttgaccgcagaccactggtgccgggcgtcgtccagatcatggccggcggcgtcgatgagggcggtggtggcttcggcgcagcatcgcctgatccactccgaacgtgacaggccagctgtctcggcggcactgtcaatgcgcgccaggagagatttcatgggcgctcatctgtagcctccagataggcgttgatgtagcgcagagcctgatccgtcatgtcgatggcggctgcctcggcagacgacacaacgggctgtggatgataagaccacccaacatagacggcgaacatcaatttctcgacagctttcatgaggtccccggcggcaaccgcatccgcctcatcatccgaggagaaccacttcaggtctgaacggctgtacatagcccctaggtcctgatgtgggtcgaggtccttg

SEQ ID NO: 289 - DNA, 3086 bp, Propionibacterium acnes
ggttacccactcccgctcatcggagttgtcggtggcaataatgcgcccgccccgggccgcgatggctgcgcacagccgcttctcggccatcgtcttgcccgcgcccatcttgccgatgaacgccaccgtgttgcctttctgatcctgagtgtcggcatgcaaatcgaggtaggccagcgactgcaacggggagcctgtgaccacagccaacgggatgccggtggtacggcccaaccggtactcaaccaccgggatagatgcggcgaacgcggaggcgtgagtcagctgacggtaggcgttaagcgaggaggagaaccggccaccgggccgggcagcccacagcaagtcctcctgacggcccacgggacgcacccacgtgaagtcaccgaacaccggatcattgacgaacgctcctgccagctcctcggtggtctcaaagtcaggagacgagacagtgacggtgataagagcctggatctcgacctcacgctcatcggcggccagctcggcgttgtagtcgacgagcacctgagcggaatgctcgatagacatgagggtcgaagcctgggtcatctcaccgccctcaacattgtcgagctgatcgacggtttggcggatggcccgctgatttttctgcatcgcagcgtgacgggtccgggccactccccggatcgccacgtcgaccggcacgccagtgtcgtcgatacggcccaggaactcgtaggcaggccacgtcatcgtgcggggcaccttacccagcacgatatgggactggtagacggtctcgccggtgtcggcaccgattttgaggacgcgacgattccacgcctgagccgtccgggacatgtgggagactcgcttgtcatcctcgctggccagcaggtcggaggtcgcggcctcatcgatgaccaactcccccagcgcggcacgtccaacctcatccatgagggcgattccctcgccaggggcatcatcacgcaaccgggtcgggtggcctgacaggtgctgccgaagccagatctgttcatcaacggtgaccgggcggggttggaacgctgccggcagtttcgcaccgaattccttagcctgacggagggcccactcccgtgcgacacggccaggagcggtggtcatgagtccggcagcttcggtgattttgttgagggcggcggtccaggcggtgtgggtgcgtattttctggtcttggttgagtttgatcgataggaaccacacgcgccggcctagggatgcggtttcaggctggtcgagggtggcgtcgatttcgtcggcccacacggggtgttcgctcaggtcgaggccggcggccatggcgtcgacgatttctgtggggtcggtccaggtgagggccccgttgaggcagaactcgtggcgggcgaggtggcggaataggtcgcggtgagctgcggcgacggtgagggaggcgttctcggtgacgggtcgctggaggggagtaagtcgccaagtggcccagatgtcgccggtggaggtccagacgaggttgtcgaagaggaaccgttcggggatggacatcatgactccttttcggcggcggcgaggaaggcttccaggccgctgcggcgtacagcgttcccggtagggtgcaggggttttctgggggtgggttcagatttcgaatgtgggaagagtttgtggatggtatcggtgtcctcggcgagggcttggtcgagcaggcaggtggccggggtgtcggtcatctcgtccagctcgtcgatcatctcgtcgaggaggttgggggtggtggatgcggcccacacaggtgggatagccggtgcgggtcgaggcggtgtggggaggcggagtttggtttggccccagaggggtgtgtgggtcatgccggcgggagtggtggcggcgtgagtggtcacacgccaccagcccgacagccatgccagaggtgaccaggtccagtcgatgcgaccaacaacgaactgggcgagccatccggcagccagcgcgaaaatgaaaccgcggatggtcatgcccccgtcgataattttgaagcccatcatcgcggcaggaactacgccgccgacagcgagcacctgatagatcgtgtagggcccgccaggaatccttcgacctgaggaatccttgccgataatgcggggctgctggcgggcctcggtgtgccactgaatatccacgatcagctcttgcccaatccttgcatcatctgtccgaagaattggatcgcgttaccttcgataagccagtgcgccataccacacacaaacagcatggagacgatcttggccaggctcataccgtgtttgaagatgttgaacgcggcaatgcccacgactacgaccatggcgacggctcgcaccgcggactgaccttcacctgccttgatcgtcgtccattcgaagaggttctgcgattccagtggcagcaggaggaattgatcgagcatgagaggttttcctttcaggaagccgaccgggatggtcccggtactgacgggctggacggcacgggtgtgccggccaggggcagaaggcgtgacggctggtcgagggcggcaacctcccagcggcctgcacgactgacaagagtcaggccgtactggctagtccgggtagtggattcgtcaccggtgggctggcatgtcacggtcaccgtgacggtaatcttctgccgatctgagggggtggggacctcgtcaggccccaccacatgagtggttttcaccgatacacacggggctgggtcaaccgcggtgaaagcggtccccgggctactccatctcgacaggtcagtattcccggtcagcatggcggccaagaaacccgaagaggtctgggcagccgggtcagcaggacgaatctccgaggagtccacgtcgggggctgaggccggtgcaggcatggggatctgcccaggtagacgcaaggcgatggccttgccgccggcatcgacgtggaccggaaccgaccaggcctgtccgctcccggattggccgcccatggtgaccacggtgacctgccacaggctcggatcagacggggagacggtagcgtcataggcggtgacggtggtgggcg

SEQ ID NO: 290 - DNA, 3075 bp, Propionibacterium acnes
attttgtccacccacccctgtcgattttgtccgccaagtattagacaaaccattagacagtgaattagaccttgggtcgcgtcagcgtgttagctcaccaacgcgcgcgcgcgcggcggccgagccgccgaagccaaagaaacccataccaccaacgcctgaaccagcagcccccgcttcagacagtcctgtgtcagcgcacgctgatgaggctgccgagttggcgtggcggttcgtggggtggtgtcctcagctggtaggggcaccgaagaaggtgcgtggccagctccgtcagatggttgccaagcagatccgtctccatcgtgcctggctggatgtgccggcgttgactgttgccgctgagcgagtccgggaaatcggggcgctgggtgatcggcactgcgagatcgttcgagacgagctgcacggggtgatcgccgaccagaaggccgcccccgcccgccccgacgccctgcacgcgcgggagcccaagtggtgggacgacgtgtactacgaaggaaacacaaccgtgtggtacgactctgacgaaaccagtgacgacgacgaggcgtggaaccggtcgcaggtatgtcatgttgctgagcgtgacgacatggctggcgggattgctaccaacctgctggcctcccacgctgatgatccgatggcctggctgactcgccgtcaaaccatgctgatggctcgtttcccccacgcccagaacgaggtcatcgcgatgtgccacatcgtgcgcaccgccctggaggccgacatggccgccggaacccggtgggaggactgatgagggtctcccggcgcgccctcatggccgtggcccgtgccgacgctgccgcagcagaccatgccaccggccgatgggtggccacagccaacgccaccgtcgcccggctgaccggactgtgcgaacgcaccgtccaatacgcccgcgccaccctggtccacctgggcctgtgccgcgtcgtggccaccggccgctacctcaccgccgacgagcggcgcacggctgctcgcacccatggcggccgccagatgcgcgccgcctccacccgcgtcctcaccatgtcctgcgcaatcgtttgcgccctaccccgaaggggtcaccactacaggaaagttaagttcctagatggtcaccaacgcacgcgcaggcgcgtgcgaaggccagcaacaccagagaagaaacccctgtggctgcaaaaactcgcagccctcctcgaccagcacctgccctggctggtgagaaaccatcacatcggccgactgtgccacgccctcaccgccctgggcatcgacgaacactggcaacccgcagacctcgacgccctcctcgacgccatgaaccgcaggaaccgtcgcctcggcctcgacgtgccatgcgccgacgaccagcacaaccccttgggactgttcatccaccaggcccgagacaccctcacccacgacaacccccatgaacgccgcctggcccgcgaacaccaccgcgcccaactcatcgacgaccaactccgccgccgcgcagaaaccgccacctgcgcagcccgcctcgcagccgagcacgccgaccccgactaccagacccgccgtcgtgaacgcagggaaaccctgcgagccacactcagggccgcccagcagcatgtcaggacacactgatacccgctcatacacacaccgtgaaacacgacaagccacctgacagtatcagctgcaagacgcatgacaacatagaaggacatgatgaaatacacatagacacaaccccgcacagcagtttcgcaacaaatcatgatagtctcatggcagtatcgcttgatacacacatagcatcactcccacataggcagttatgctgatatactcctactaggttatccgtccaacatgctgagtgggttcctgtacagcatgaaaggagcatggcatgatatgggccgttctcaactgcaagggtggtgtcggcaagacgaccagtgccctcctgctggcggcagccgccgccaagcagggccacaccaccctggtggccgacgctgacccccagggcaccgcatcccagtggtcagccctggcaaccaaaaacgacgaacccctgcccttcccggtgcaagcggtcaacatcgccaccatggaggcactgcccaccaccaccgacgcccatgatctcatcctcgttgacacacccccctcggcaggcgatctgatgttccaggcatgccgcatcgccgacctcatcatcatccccaccgccacctccggacccgacatctcccgaacatgggtcaccatggacgccacacaaggcacaccacgcgcgatcctcctcacccaaaccgaacacaaccgtgtcgtctaccgccaagctcgcactgccctcgccgccgacgacaccgtcgttctcctggaccacgacatcccccgccgtgaatccatccgcacagcatggggcaccaaccccccagacgacgtcatcacctactacctgcccgtcctcaacgaactcatggaggccctgtcatgaccaccaagaaaaccgacccattcgcccgccagaaagcagcagaagaccgcgcccgccaactccaagacgaagcccaacgccacgcccaccccaaacgcgtcatcggccccaccgcacgattccagttcgtcctgccagccgacgtgctcaccggcctcaaacacctcgccctcacccgcggcaccaccgcccgccaactcaccctcgacgccctcgacaccgcctacggcctcgacaccctcgccaacagcgggaagaaaacccacccatgacccgtgggtccccctgccaccaccccctcgacggcaactgtgtgcgagccacaggcccgcacacaggcggcagcccagtgccgtccccgccaggaaaggaactgaacttttctggagtgctggctccctatcaccccttatggtgctatcagatccagtagcgccagcccgagaggaaacccatgagctacatcgtccgcaccggaaatctagccggcacccccgagctgcgcgaggggtagccgacacggcggaccgtgcccctga

SEQ ID NO: 291 - DNA, 2821 bp, Propionibacterium acnes
ttcaagttccgggaactaccgccggtcacgctgattgattcccgggcgatctcgcttctgacgacagtggtcggtgaccgagaggagtcctactctgaccccgctgctgcggtgagtaaatcacgggcgtcccggatccggccacccgtccaagtgccagccagcttgatcggctaggcatcgtcaaggagcgacgatgaggtgatgatgcgatgtgagcgcaccgcgaagtgaggtataaagaagccttcccgggcgcatgcgtcgcccaggaaggccaggttggcccctggacggctgaatggttgggcggatcaggctgtagcggagacgtgcagtacctcgtaggcgatggcgttggttgggctctggtctgcatcgtggctactgagttcgacgaggatgacggtccaggtggtgatgtcgacggcggtgacgcgggcgatggtggaatcagtggatgctgcaaggaagtcggcggttatgtcttcgatgcagtgggacggagcagtgctggtgggcaggggcacggtcttgacggtcaggcttcgggcagcagagtaatcggcggttccgttaacaagctggtggacggtccagtcctggatcgggtgccggccgaagtcgcgtacgatagccgagtaaccaagttcgccccagcagaactggcgcatcccctctatgtcgcgccagacgtagaagggcgcgtaggagttctggggtgcgcctttgaccttttcttggatgaggtaggccttgaactccagtccatggtagccgtccatgaggtgtccagtctggatgacgcggtcgcggatgatctgcatgtcatagtcggtgggcagggtgatctgatattgcatggcgtacatcagcggttctccttggtttcgtgggagtaggtcgtgggggtgacgggttcctgccaatcgatggttgacaagtcgtcggcggcttgttggtaggtaaggtggatcattggctgtttgagtgcagcgccatgccagtgtctctggccggcgtcgatccagatggattcgcccttggtcaggtgctggggtgcttgtccttcaatatggaccagggcaacgccgcccgtgacgtagaggccctgtcccttggggtgtgtgtgcctcagcggcaaacgtgacggcgtgggcggcacgcccggcgtcttccgtggcacgatcggccggatccatggcggcgcgcagctgctgttctgcagccaggcgtccaggtcacggcgggcagcatcgacacccagggcagcctcgacggcttcagggctacgacgctggccgggctggttgaccgcagaccactggtgccgggcgtcgtccagatcatggccggcggcgtcgatgagggcggtggtggcttcggcgcagcatcgcctgatccactccgaacgtgacaggccagctgtctcggcggcactgtcatgcgcgccaggagagatttcatgggcgctcatctgtagcctccagataggcgttgatgtagcgcagagcctgatccgtcatgtcgatggcggctgcctcggcagacgacacaacgggctgtggatgataagaccacccaacatagacggcgaacatcaatttctcgacagctttcatgaggtccccggcggcaaccgcatccgcctcatcatccgaggagaaccacttcaggtctgaacggctgtacatagcccctaggtcctgatgtgggtcgaggtccttggaatgatggaagttcctacacacccatcgccaaagacctcaacatggacaacgctaccttcaccactccctcatctgtgaagagccagtttatgcacggtgttgaaagaggcgtcggtctacgacgaatgcgggttaatggtcttgcggtgtggggcgctgggcgatggcatcgagaacgcgtgagtgggtggcgatccattcggccgcgtcggggttgatgttgcgggcgacggtgtcgatcgctgttacgtagtgggcaagcctgcgaatctcagcttgttggtcagggtgagcgctgatgaggggctcttgatgggaggcgcggttacggacgtggcggatgagctccacgttttcctcgaagtcgcgtcggctacgccccgggtagtgaggcatacctccgttacgtaagtcagtgagagctttccatacggttgcttccaggcgcggggtgagcagaaagcgccagttgtccagtgacagactcgccacgatctgatcaggggtcgcatcgagccccgcgcgccgcagtcgcgcctcggccctggcgacgttacgcgggaaaccaccgagccgatagctcggggattcccaccaacgccgtatgccagtatcggcgctcaggcgcacgtcaatgaagtttctcaggagtacctcgacatggctgatgtcttccaagaacgctttcgagatgcaggtgttccacacgtaccacgcatcgactggttcgatccggtagcggctgagcctggcgggtgagaaccactcctgcaacgtctcacgactcaccgtgggagcgtggtaagattgatgacgataggcctcgggaaggtcaatgccgcgaaatatcggtatacccccgaggtcattgtcttgcccaggcccctcctcgcatacttgcggggcgtcattggctgccgtcatctcgtctcttcccggtacgtggctgtccatgttcacgggcaggtacggcaatgaggttcccgcacacaaacctctaccaagcatacgctggcaagccgttgcatgagacgacgcctccgcccgccacaccaacggtcaccgccacggccacggtgaccgtgaccgtg

SEQ ID NO: 292 - DNA, 2653 bp, Propionibacterium acnes
tggtagcagtaggcattcacccgtgacccacggttaccggaagccccgccgcaatcgataccactgtcagtaccatcaggggcgataggggtcaagctctccttgtcacaatcccttccccggcagcccagtaaccgtcgcttacagccatacatggatatgcgcccattcgtcggcaccgacgccgtgcgggttggcgacgctgacccgtctgctcacaaacgacccttccagcccagcaccacccactacaccgacacgatccacgaagctgaaaccgaacctcccatccccgtccgaaacatcaacgaactcatcaaccccaccaaccatgcatgaacgcacgatcgcctaccggccagccttcctgcgcgacgtgaagcggctcaaaaacaagcactacaacatgaacacacactcaaatgggcggtaaggtcacgaagtcgacgtggctgcctcacggatggcttcggcgagctcttggggtcgactccacatgggccagtggccggttggcagatccatcgcggtgaagttggtcaggtgcgcgacggcgctgaacatcggattgcctgctgcggccagctcgaggacctggacgctgggaatggagcagcagatcaacgtggttagtacatcatggcgagcgctattggacagcgcgacccgtgcccgggccacttgcgcgggttcaggaaccgcccgtgcccggaaccggtcaaggtgctcgttgctgaggccctctaaactggcctgcttgccgagagtatcgaagtcaggaagtggcagctcagctgtttcctcaggtagatctggtgcgaaggcacctccatcgctcatgggaccggagtccacccagacgatccgatggaccaactctgggtgcctgtctacaactaggctcaccggcccgttcgcgccactgtgtcccaccaggaccgcatcgccgcccatctcgtccaggatggctgagatggcgtcagcttggtcgtcgagcgtgcgcgtagtgcgctgggtgtcctccggatcgaggccaggcagcgtcagccccacggctcgactgccagcagtgttcaataactcgactacctcgtcccaagcccaggctccgagccagtaaccaggaacgaggacgataggccgatgctggtcaggtcgcgatgttgaagtcatggagacatagttgcacagtgcgcggacaagggagtggcactatttctggcatgaatttagatctgggtgtccggtgaggcgatcagaacgcctccatgtactgtccgagtgtctacgatgcagcggacacagtcgagcagctggctcacaagtttccaggtgtccttctgcccctatgagggaagtcggctgctctcgcaacctttgagggctgctctggggtcggaaccagttacagatcgttcaagttccgggaactaccgccggtcacgctgattgattcccgggcgatctcgcttctgacgacagtggtcggtaaccgagaggcgtcctactctgaccccgctgctgcggtgagtaaatcacgggcgtcccggatccggccacccgtccaagtgccagccagcttgatcggctaggcatcgtcaaggagcgacggtgaggtgatgatgcgatgtgagcgcaccgcgaagtgaggtataaagaagccttcccgggcgcatgcgtcgcccaggaaggccaggttggcccctggacggctgaatggttgggcggatcaggctgtagcggagacgtgcagtacctcgtaggcgatggcgttggttgggctctggtctgcatcgtggctactgagttcgacgaggatgacggtccaggtggtgatgtcgacggcggtgacgcgggcgatggtggaatcagtggatgctgcaaggaagtcggcggttatgtcttcgatgcagtgggacggagcagtgctggtgggcaggggcacggtcttgacggtcaggcttcgggcagcagagtaatcggcggttccgttaacaagctggtggacggtccagtcctggatcgggtgccggccgaagtcgcgtacgatagccgagtaaccaagttcgccccagcagaactggcgcatcccctctatgtcgcgccagacgtagaagggcgcgtaggagttctggggtgcgcctttgaccttttcttggatgaggtaggccttgaactccagtccatggtagccgtccatgaggtgtccagtctggatgacgcggtcgcggatgatctgcatgtcatagtcggtgggcagggtgatctgatattgcatggcgtacatcagcggttctccttggtttcgtgggagtaggtcgtgggggtgacgggttcctgccaatcgatggttgacaagtcgtcggcggcttgttggtaggtaaggtggatcattggctgtttgagtgcagcgccatgccagtgtctctggccggcgtcgatccagatggattcgcccttggtcaggtgctggggtgcttgtccttcaatatggaccagggcaacgccgcccgtgacgtagaggccctgtcccttggggtgtgtgcctcagcggcaaacgtgacggcgtgggcggcacgcccggcgtcttccgtggcacgatcggccggatccatggcggcgcgcagctgctgttctgcagccaggcgtccag

SEQ ID NO: 293 - DNA, 1468 bp, Propionibacterium acnes
cgtccagatcatggctggcggcgtcgatgagggcggtggtggcttcggcgcagcatcgcctgatccactccgaacgtgacaggccagctgtctcggcggcactgtcaatgcgcgccaggagagatttcatgggcgctcatctgtagcctccagataggcgttgatgtagcgcagagcctgatccgtcatgtcgatggcggctgcctcggcagacgacacaacgggctgtggatgataagaccacccaacatagacggcgaacatcaatttctcgacagctttcatgaggtccccggcggcaaccgcatccgcctcatcatccgaggagaaccacttcaggtctgaacggctgtacatagcccctaggtcctgatgtgggtcgaggtccttggaatgatggaagttcctacacacccatcgccaaagacctcaacatggacaacgctaccttcaccactccctcatctgtgaagagccagtttatgcacggtgttgaaagaggcgtcggtctacgacgaatgcgggttaatggtcttgtggtgtggggcgctgggcgatggcatcgagaacgcgtgagtgggtggcgatccattcggccgcgtcggggttgatgttgcgggcgacggtgtcgatcgctgttacgtagtgggcaagcctgcgaatctcagcttgttggtcagggtgatcgctgatgaggggctcttgatgggaggcgcggttacggacgtggcggatgagctccacgttttcctcgaagtcgcgtcggctacgccccgggtagtgaggcatacctccgttacgtaagtcagtgagagctttccatacggttgcttccaggcgcggggtgagcagaaagcgccagttgtccagtgacagactcgccacgatctgatcaggggtcgcatcgagcctcgcgcgccgcagtcgcttctcggccctggcgacgttacgcgggaaaccaccgagccgatagctcggggattcccagcaacgccgtatgccagtatcggcgctcaggcgcacgtcaatgaagtttctcaggagtacctcgacatggctgatgtcttccaagaacgctttcgagatgcgggtgttccacacgtaccacgcatcgactggttcgatccggtagcggctgagcctggcgggtgagaaccactcctgcaacgtctcacgactcaccgtgggagcgtggtaggattgatgacgataggcctcgggaaggtcaatgccgcgaaatatcggtatacccccgaggtcattgttttgcccaggcccctcctcgcatacttgcggggcgtcattggctgccgtcatctcgtctcttcccggtacgtggctgtccatgttcacgggcaggtacggcaatgaggttcccgcacacaaacctctaccaagcatacgctggcaagccccgacgagacgacgcctccgcccgccacaccaacggtcaccgccacggccacgg

SEQ ID NO: 294 - DNA, 2704 bp, Propionibacterium acnes
gggatgaggatgacggccgcgccgacacttcggagcgaggtcatgtgacgatccttcggtagctcgacgggttgccgtagatcttttccacgttgatgccactatgtgggttgtcggcgctaaccatttggcctccaccgatgtagacggccacgtggtgggcagggcttccccagaggatgaggtcgccgactttgagctggtcacgggccacggcagtgccgactttctgctggtcggcggcggtgcggggaaggctaatgccgatacgccggtacagcgccgaggtcaggcctgagcagtcgtagccgccatcggctttgccgttgccaccccacacgtaggcgtaggagttgttgtcggcgatcgatttggcccatgccacggcttcggccaggttcttcgacacaccggtctcgttagcggccccggtggcacagttgtttgacaggtgccctgtagtagtggatcccactatttgtttggccatggtttcccatttggcgtaggcatcgggcagggctgagccttgcactgcctgagctgcctgcgtcagcggcatcttctgccagtcagcgatgtcgactaaaccgggaatgtggaatccagggccgccggccgatccggggccagcgtaggtgatggtgtggcctttcaagaacgcctcggtggcgtaggcatcattgttgacctgatccagagtcccgtaccagcccggcaggatgcgctgctgaaaggggccggcgtcaccgtcaccgttagccttcgctgaggtagggtcggccccaagatctgattcttgtttggcggtcatgatagcgatgaccgctgcctgggtaggcagtttgtcacgctggaccacagtgacgatggtggtcacgagctgcttctgcctggccgtgaggcctccggcacccacagtgcctccggtgacggtccccacgcaagcatccccgccgacactgccaccgccgccgccagagttgtcgtcgagggccccagagcctactgacagcagcggcacaatgatcacggtcgctggcaagaccgccaggcccgccagcatcagcactgctgcactcaccacggcgatcacgtgagatgctttcaacgctgcccacctctcgctggtttgagggggcgacgcctgctggtacgcacaggcttggttgatccagtccgccgttggttggcaggcctgggtttgatcggcttgctgggacccggtttgggctccggagtcttaggctccggcttcacatgcctaggcacttcggctgcggtgggaggagtcagcacgtggcgtactggcttggtgaccttctgggcacccgaaacaaccggcttagacaccaccttggcacctttgaccaccggtgcggctgccttcgcgccggccttcttgactgcacgatgcgctttgatagccccggcctcggcccggccaaccctgctagcagtagcatcgagggctctgtggcccgtcgttgccctcaccggtgcatccttgccctggcgggtctgcttcgcgatcgccgacatgccgcctcgcaatgccgaaacatgattgtgggcgtgggcgatcgccgacatgccggccgtcgcgatttttgactggccctgcggggcccctgccccagcacgaatctgccggtaagccgccgacgtgccacgagcacccgccgccattcgcgccaccttcgcagccctagtcactcccgtcgacacgccacccgtggctaccgcagcagcacccgagaccacagtcgaggccatccgccttcgacccgatccggtgagcttgcgaccaccgctgcgcaccatccggcgagcaccccgcccagcccactggccgatcaccgagcccctttcggaacgcttgctgcgcatccaatcgttgatcttgtccctcagccccttctcgcccttgtgacgacgccacatggacatcaagaacccgataatccccacgagctcgagcatgttgacaaccatgaccttgatggcgacatcaccgtcagaggcgaaaaccgacttgatgatgagcatgaccacacccaacatcaccatcgacccgacaatgccgatcatcgagtacaagatcgaacacagatcccggatgagcggatctgtgcggccagggatagcccgcaacacgttgagcatcgacatgaacgccgaccacaccaacttgcacacgtagaaccagcacatgcccgcgaacaccagcaggaccacagccaaacccgccaccgtcgacgagtaaaagaagaaacccaccaaccacgaaccatccgcaatatcgccggcgtaatccgacaacccctcatcacagtcaccaaggtcgtcgcgagcatccgagacgtcatcgtaagggccacccttgagcacctcgatgtacttgtcgtggcacttcgcatcaataatccggccatagttgagctgctgatgaaccggcgccacgaacgagtccacaatgatcgccgacagcttcggatccttcgagtctcccgtcgaggtcatgtcatcaggaatctcgacctcaccagcggtcgccgtcgcaggatcaaccgaactggtaatcatccgagacagcgccacaccgaactgctgggtgcgagccagcggagtagccaatgtcgtcgtatcgcctgcgaacttcgccaccggggccgccaagaaacccaacgccagcgccgcagca

SEQ ID NO: 295 - DNA, 2471 bp, Propionibacterium acnes
aggcagggtcgtcgggttcctcgactaccggaggtggggtagggctgagctgttcggtgtcgtcggccaggtcggctcccaggatgcgttcccattcggggctggttttcttgcccgctgaggccatcgtctcgtcgatctgttcgtcagtgggccacacaaatttctttttggtccaggtcgtggtgtcgggtcgcagctgatccagcagttccaggtcttgcggggagtgggccttgcgggggtcgggggtgtagaagaattggacttccttgggggctgattcgccggataggtaggtgcctcggccgcgtttaccgaacgggatgcccacgccgacgtgttcggagccgaacatcatgcgggctccgtcagcagacaggggtccggtggcggcacgcccggagaagttgtctcggatttcgccgcccaggaactcggcgtcggggcgttgggtccccagatcgacgtggatacggcaggcggctgccatgcgcagcagggagccgatccagccgaaaacggggcattctccgggcatcccagagaccttgatcgttgaccaccagtttttcgcgttgccgtagaactggcggtactcgtcgatgaggaccagcacgcgggtgaagtcggtctcgcgggccccttcttcttcgatgcggcggtagcggtcctccatgagagaccacagccagtggatgagggcgacctggtcggggacggtagtggcgaccatctcgatgttgggccactcccgcaggcccaggtactcgatgcgtttagggtcgatgacgaagacgcgccagttgcggcgggcaccctcgacggcgtcgccgatcatggacaccgtttttccggtacgggtgcggccggccttgagctggtgggccatgacaccggagatgtcccagaaacaggtgttgccgtcctcgtcgacggcctgggggattttctcccagtctggggagtctgggccgggaagggccacgggtcggggcaccatcgagggcagggggtggcggcgggtgacggtgatggtgtcgtgttccaggtcgaagtcgctgcgccactggccgagcatcatcgccgaggtcaccgcggccaggcgcaattggatgttcgggctggacaaatgggcgccacgttggtggtgaatggtgaagccgtccaggttcccccgatcggttttccaggaatcgacggtgaccgccgacccatagatctgagtggctacttctttagcccgttccttgtctcggtccagatcggttttgtcagggtcaggggtcggggcgcggtattgcaggacgaaccggccggccgggatcgttgcggatgtcaccgtgaactctgccggcgaccaggcagccgcggccgcctgggtgagggccattggcatggtctcgacggcagcctcctcgggggggatggtgagggtcaggcgtcgcggatgcgtcttcttgcgattccatgtgactttctgcctcaccggcaccttcgccgccgactgaatggctaggcgagctgattcggcagtttcggtacgccggccagcgcgtagcgcccgtcgtgcgtgaaggctgcccaccacagcacagcccatacacggcagccaccagcgcggatcagcggctgctgcatagcccccggtagctagtaccgcacctgaccagccggccgcgatacttttccacgccggtttcgcgccaccaggaccagcgttatggacggtctgcttcgaggctgcggagggacgagacagcggagtgctggtcatgccgcggcctccttgtggcaggtcatttcacaggcatgccggccagcgatgatgccgtggcgcaccgccccggtagccgcatagaccgcgcacaactcaaacacggggcacccatcgcaggccgccgggttcatgctttctttgtcccacgatggtgggtcatcggtgcacggcacggccaggccatcctgttgagcggcgctgatagcggtgaataggcgcagctgggcgcgaacttggtctggggtcaggttgacggtgcgggctacacgcatggggttccttcctcttcaccagtgaaggttccctagacccggccgatgtgcggagagatttcagtgttttatcgaggtgaccagccatccggtctgcgctgcgggttcaggtaccagggtcagatgcagcatggtgtggtcggctaggggcacggcgaccaggggcccgtcggcgctcgccccggtgagggtgggagttccggccacggtggtggcaggaatctggttgggtttcgcggccatcagggagcccatgagggtcggtgcggcgatctggacgagggcgactttgcgggcggcgggatcgcgggtcaaccagccgcgggtgaaagcgagcgccgccgacgtgatatcggggctcagcggggctggagtggcggctgggtgggccgttgaggagggccacacgcgcggtagcg

SEQ ID NO: 296 - DNA, 2537 bp, Propionibacterium acnes
ttggtattggtaggcgatggtgtcaccggttttgttgcggatgacgtcgaagccttcgatgtcggaggggatgtcgtcggcgtcgtagacgacggtggtggtgacggggttggaggccgacatttggccgatggtcacgcgcagcatgtttttcaacgcggaggtgaggattgtcgtggcggtggggttcttgtctgcccagcgtttctcggcgatgtcgatcatgtcttggatggttttgacccatcctcggatgggatcgactttggtcagtttgatccctccaaggaactcgatgggcttagtaacgggcccgtcaggaccgaattcggtgtcccagccttcgtcgatggctagtttcagttcggcggcgtcaacccatgtttcgtgggtggtgccgggcacgttgggccaaaaccatcctgctcgtcctttggtgcgtttgaccggtagtaggccgatgtcgtcccaccaggatggcacggtgaagcggatgtggtagcgggccgggtgccaggggttgttggtgaacaggtcgtgagcttcggtggcgctgagcagagtggcgggtgcggcaccgatctctccggtcactgatccggcatacatgaatcggccgtcgatgtacacgaagttagggatagggccggcaggcacggtggggcgccaaccttgttcgcggtcctcggggttgccgtcgtcgacgcatagttcgtagcggtgctgaggggaggtgtgttggatgagtgcgcccagttcggggtccatcggctccatgcgataggactcgggggtccgtagcttccagaggttgattccttctgctccggggcggtccatgagggcccagtcgcggtcgattctggtggcgatgatgtgggttaattcgcgccatgcccagcgggcctggattggggtgagggtctggccagggaaccattcatcagcgaccagaatgtcgaggttgcggtcggtttctttgtgggtgaaccggcctcgggcgggccgcccggacagcatgaacaggccccgcacgtgccagtcctggttgaactcgcgggtgtgagcgggggtgtcaggcagcagccaggattgaggctggtcggggatgttaccgcagacgatcaggcgtcgggcgttgtggtgtagcgcggttgttagcaggtctgacagggtcgcgtgcttggtgcgccgcccccctagcactggcaggatctcgtttccggccgcgtcgactccccgggcggtgtcgatgtctagccacactgtttcggggtcggggggccgatgtggggcgggacggcgctgctcctggtcgtctctcatggtttcctcctttgggccagggagcggccggcgtcgagggcgttcatgcgctcgcgttgttcttcgcgtagttggtagacccggcctcgtgacactcctgctgcctcggcgatggtggtggccggcaggtggccgatggcggcagcgtcggcaaggacgtcacgccaggccaggtcaatggttcccagctgggctagagcttcgtcgcggcggcgggtggcatcagccactacggaggcccaccctgtggggtggatggtcttgacgacgattcggttgtggcggatggggccccatgcatcagcggggacttgccagccgtgattggcggcggactcggtgatcttgaggcgtcgctcaggtgcgcgggtgcgggcagtgacgtcggtgttccaggtctggactggtacccacgtcccctctcggatgcgttcgatgacgcacgtggtgacctcgtcggtgactgtgatgaccagacgataatctttcccgtctggggtggttcggtagctgggcatgtcaccctcccctatctgtcaaatgagctagacacagtgtctatttaatttgacgcaaagtcaagtgcattagacgcctttgtgtggatccgccccaccagacaaacactcgcgcctcatgacccgccgcgaagccttaacgaaaccaaaccgcttatagaaccgctccgcagcgctccccgagggctttagctccaaggtaagaccttgctcgtcggcccattggcagacttgtgtgaggatctgtgagccgtagccctgatttcggggggcggcatgcacgcacatcagcatgtgaccatgacggcgggtcggcgggctgacataagccccaccacgccagtccggtgtgatctgccaacttcgccatgccgcagcgcgccagcggcgggcctcggtagccaccatgatcaccgcgacgacgacgagcgttgcggccccgatcatggccagctcactccagccaggccagttcccggagatgatccagcctcccagcgcccagatgatcatggcttccacgcccgccgcaatcgggacgagtggggcagtacggatgcggcctgccatgatttcggtgatctcgctgcgatgccacgaccaagagaactcccacgaggcacgaattaggctcatgcgtgaacggcttcctcggcttcgctttgccatagcttctctagacggcgctcggct

SEQ ID NO: 297 - DNA, 2332 bp, Propionibacterium acnes
ggcggcgcaccaggtgcgccgccttcccccgtgctggtgtctcgtcggcttactggtgggggtcgtaggggaacccgtaggtgtgttccagggccttgcggagaaggtcgttcatagttgtgtgttcggcgacggccttcatcttcagcgccgtgtgggtggcggtgggtagcttgacgttgaacgcggtgatcggggtcttggccgactggaaggtttcagagacactggctccctggctggccgccatttggtcggcgtaacggctggctttgtcggcggcggtgggtttgcggttcttactcacttcagcatctccttgattcggtcggcaacctgggcgaactctcctagatctgttggccgggttccgatggcttgccgataggcgacccgtcgatgaacctccgcatcgagaacgtctaggccctcaacggcggcggccccctcgtgggcatcacggtattgcctggtccaatcggctttgttgaagagcagggcccggcgtgtgccgtgggccacctggtaggtcattagcgctcggtccatgtccaggtcccccgactcggtcgggatgatgaccacatcggcgatgtcgagggctgcggtgatcgtctgagagtcaccggggggagtgtcgatgatgacaaggtcggcgtcgatgtcacggcagcgcctgacgataggggcattagccgggcggacctcgaagcccagcgggtcaccagtctcgaaagcgtcggtagcccatgacgtcgccgatccttgcgggtcggcgtcaagcaagatgactcggtactgagctgctaaggccgttgccaggtagaccgccgtggtcgttttcccgaccccgcccttggtgttgacaatagaaatactacgcataaatacatcattacacatgtgcatcgatgtatctgtatatatgtgtatcggcgtgttgtgagggaaaacccgggccacatacaacgatcccccagccaccacagccgggggatctctcagtaaagccagcaactcccacagaagttgcacccccacgatacccaccacatccgtgtcaagcccccacaacacccaccagcgccctaggcttcccccatgaacattgacatggacacaccaaccgaaaccgaagccgacaccttcgatgccgtcctcgccgacattaaccacatcaaccgcctcaccgccgacgaaatcgagtgctactccatgggagcctgtctcctcctcctcaaccaccaccccttctccgaactccgccaacactgggccgacaaccccaccgacgaaaccacgtggaccctctacggggccatcatcgccgcctccaccctggacccccacctcagcatcgacgccctagcccgcctctaccagctccccctcgacctcgtgacccaagccctcaccgtctaagcgtcgatgagcgggggagaggtagcgcactatcggctaaggaaccccacaaacaccaaacccttgtcactgggaagggtttggtgttatgctggtctcacaactcaacagaggaggtgagacatgggaaatgagtaccagaagtcgctcaaagtcctgttcaagaaactggaatctgagcaaggagcccgcatcgagacccggcgcaaaggatggatgatctacccgccggatacgtcacgatcagcggtcatgatccacaagactccatcagatcgcagagcatgggccaacatgctttccgaactgagacgctcaggattcaccgtctaactcagtgaagggggctggagctccagccccctttcaaccacctcccccggacaccacacaagaaaaggagaacatgatgtggcacgttcggttgtcgcttcgcgcaatcagcgaggacatgctgttcgacgccctggacaccctcgaccccttatccccggtggccacactgggccccgatgagcacaccggatcattggcggtgttcgtcgaggctgactcactgacagacgccatcgagactgcccgcacagccatcaccaacgcatgcaacaccgccaccataaccggcgtagaagcccgccccgaagacgaatgcttcgcagacgttgaccggcccctgttcccgccagtggtcggatacaccgaaatcgctgaaaccgcaggactctcacgtcagcgcatccgccagctcgcaggcaccgccgggttccccgcacctgtcatcaagaccgcggccggcccgctgtttcccaaagccgccgccgagcagtgggcgcggacacgccagcctaaggcaggccgcccaaaactccagaccaccacctcataacacatcccgtgtgctgaacctgtt

SEQ ID NO: 298 - DNA, 522 bp, Propionibacterium acnes
cgacgccgcggcggggtaacctcctcgccccgctccaactgtgttaacgcctcgaccaggttggtgcccggtttcagcccttttagcacgaaccgcaccaggcgggggtctcggccgattcgtcgggcaatctcggcttggctccacccttcggctaacagggtgcgcaacaagtcttgggcccggttatcacgctcagtcactggtcgcctcctcggggagtcctgcctgctcggcctgctctgatagagcagcccgttccgatccggtctggggcgcttccaaagggcccggcaagacacctttgacacgcagccgcccgtccttgccgtcatcgccgcccccctgggccacagggagcgcccaggggggcacgttgctggtgtagatggcgtcgccgtggatggccagcagggtgcgggagttcatgcgtagtgctcctcccttggttgtggcgttttttccggtggtggggtcggcgatgggtgtgttgagggtgcgtacgcgggacagggcccagat

SEQ ID NO: 299 - DNA, 522 bp, Propionibacterium acnes; identical to SEQ ID NO: 298

SEQ ID NO: 300 - DNA, 2317 bp, Propionibacterium acnes
aggtcgggatgatgggtgctgttgctgatgcggccctcgctgctggcggcgctgtgatcggagtgatgccgcagcacttggtggacggggagatcgcccatcctagtctgactcacctcgaggtagtgcggactatgcatgagcgcaagcagcggatgagtgacctagctgacgcgttcgtcgcgctacccggcggcggcggaacccttgacgagctattcgaagcatggacatggcagcagctcggtgtacacagcaaacccgtggccttgtacgactcgaccttctgggcaccgctgaccgcgctactcaaccacatgaccatcgaaggcttcatccgccctgaggaccgcgcctcgctcgtgatcgccgataccatacatcagctgatggccgatcttgagggatggaccccaccaccaccgaagtggcgctcgtgacatagaacaaatgattctgactatggctcattgacatctgcgcagcggctactagctccattgacttcaaatcgggccttggccgaggctcggttcaggtggcccggaatggatccccacaaattgaatgctcatgatcgaggtgatgaacgcccactctattgtcctacgcccggttgtatccagcgagcaattgaaggtgctgcgcctgttggtcgaccaggccgagccactcatcatcgacgggcgcatcttgtacgaggcatgggacaggctgcaaacagcccgtccggcccgctagaaaaaatttttagggcccgctccgcacatcccggtctgtacccacaccttcaagggtgtgaagggaataaaaacacacctaacaacaactttgtttcatgatttggcgcgtcggaccctttctgaccgatgtcgtgcgcaacaatggacccatgagttcgcctaccaagatgcgccggaaggggacacgcggcccgaaacctcgcagcgacgaggagctaacggctgtgatgttccgcgtcccagagtcagtggccgaacgtgtcagcgatatggcttgggagctgaggctctcccgatccgatcttgtgggctggtcggccctctatgcactcaactcgatgctcagacagcgcggagaggacacgattccggttccggagtatctggacaaggccgtgctcgctgcgttgtatcccgatgggttgcccttcgacgaggacaccgaggagccgggcgagaatgccgggcaggaggagcttgcgatgactggatgagcccgaacatggttgaaggccgccccgccaggcgaccttcaatcaatggtttcggttgtcagctgcagccacccttgccaggtgctgtggttcttctccagaggaggagggaccgccatgaagacccagaagacctagaagatccaaaagaaccggtttcggctgttgcttcggtcttcatggtagctgatagcccgcgtcgttggaagtgcgacgacgccgatcctcatcggtatcgcaccctgttccagggtcgagaatgtgaaggattaacaaccatgacaagtcatgagacgccctcccggagggcgtcatgaccgctttaattcaagctctgccgacagctgaactgtctgctggacctggtgctagcagtccagctagaccctctgctgagggcttcatcaagattcaccacgacctcattagtgcgggcgtgtcgggtaacgcgatggcgttgttcgtcgcgttacgtaaccagcccggctgtgatcagtggacccgtcactcgtacctgcggctagcccaatggtgcggctgggatgggctgtcggaggcggcgggctgtaagcgggtgcagcgggccgctgctgagctcgctagcggtggttggctggaatcgcgggtcggccatgatcgtcgcaccgctaagacgctggtgtggcatcggttgaccagccccgacaccgaccgctgggagcaattgccgcggattgtgtgggcgaggatctgccagatcgccggggagacgtcgggagagtgggtgaggcattggctggtgtggcggatgctggccggtcgtactggtgtggctcaggcccctacgtccatcgtggcccggttcctgggctgttcttcgcgccaggtctctcatatccgtggggctctcgttgatgccggtctgctcggctgtgacgaggtctcgggggcggcgagccgggtgtggttcccctcgatggccgaggagtgtgcagcggatcgtgaggtggtcgatggggccgtcgtcgatgctgaggtgggctctggtgaaggtgtcgaggagggcggggaacccctgtcgattttgtccacccacccctg

SEQ ID NO: 301 - DNA, 2290 bp, Propionibacterium acnes
cccccaccagccagcctggccgtcaacggatcaacgtcaccgtctacgttgtgcccgaactccatgagcggctgcgctcccgatcggcggcgacgggggtgacggtctcggatctggtggtgcatgcgttagcgttcgtcgccgatcatgcgggggaggcgatcgccgatgatctgcgcgtcgagacgggccccggcatgggggccggactgttcgatgtgaccccatcgcggccagtaggggtcgccaaaacccagctgggggtgcgaatgacccgccacaacaaggatggcttggaccagctgacccggacgagtggggcccgtgaccgcagccatcttgtgtctgtcgccgtgcgcgactatctcgactccaaccctgtaaagaaaggccgacatgtccgctgatgaaactcctgccgcccggggtgggcgacgctttgatacgaccgtcaagcccaggcgccgtcccatgcttatcgccgccggtatcgccatcgtgatagtcggcgcgctcctcatcactcagttgattcgctccgcccaaaccgagcatcgcgtgctggaagtccacgccgatgtggctcgcggcgaggtcatccgtgacaccgatctggtatcggtgactgtcggccaggtcgacaacgtatcaacggttcccgcagaccagctcgactcactggtcggcaaacgcgccacggcagatcttcgagccggatcactcttgcctgctggggctatcggcccggccgatgtcgttccagctccgggcaagtcgctggtcgggctgaagctagccgccggacagatccctatcggagaccttgctgccgggacgaagctgcgcctgatccagacgtcggcacccagcggctcatccaccaccactgatagcagcaccaataccgatggccagtcgtgggaggcaacaatggcgaccggcaccaaaaagaccgagcaggtcaccttgatcaacgccgaagtgaactcgcgtgatgccgcccggatcgcccaactgacgtcacagggccgtatcgccgtagtgaaggatccgatccgatgagcaccattgttttgaccagcgtctcgggagccccaggggtcaccacgacagcgatcgggctgggcagggtctggccacaatcgagcctggtcgtcgaggatgacacccaccacgccatgctggcgggctacctgcgagcctcccagcacgccgaaccgaacctggccgcagtggcgaacctgacgtcgactccaaccaacgcccaaacggtgtgggaatctatcgccagacccctacccaccgatgacccagtcggcgggctgcgacgcaaaggcatcctcggcccgcccacgccgtggtctcgcgcaggcatcgacccccgatggggattcatgctggccctgtggcggcaactggaggaggctggcatcgacaccatcatcgatttgggtcgcctagccacaccactgacctcaacgccacacctgatcgccgcacccatcgtcgaggacgccgacatgatcttggtgatgatcgaggcgacactacgcgacatcgccggcgcccgcacgatggtggagggactcgctgagcagatgaacttggccggcgcctaccgacgtctcggactgcttgtccaccgtggcggccaggcccgcggcgtcgccgagttcaatgacaaggagatcacctcggcgttacgactcccggtcatcggggccattacccatgacccggccggagccgcccaactctccgacggggtcgggcagcggttcgacaagtcacgtctggcccactcactatcaaaggtggcggccagcctcgtcgatgccataaacaagcgccacgctgatgacgaggaggatctgtgatggccagttttgctgataatccgttcgacaagctgcgctcccaggatgcggcaagagcttcggtagagcaggagcctgatgccggattagcgtcggagttgttttcgacgtcgtcggggtgggccagctctcagcaggtgtcccaagctcaaccggtgatgacccgttcggagaacgtggattggccggttgtcgcggagctagccagtacggccactgatgaggttgaggctgagatcagccggtggagttccactcatgatggggtggcgacgctagacattcgccaggccatcgcggagcctgctattgcctcggcggtgtctacgtatgctgaccgacgccagatcgatgtaggggagacctggcctgatctggtacgccagcgataccgcaaggctgtgtgggatcag

SEQ ID NO: 302 - DNA, 2310 bp, Propionibacterium acnes
ctgtgggagacgatcatcacgtacccgttagatcgtcgccctgacaagatcgctgcgaacctcatcctcgacacgttgcaccgggttacccggttttggcgtgctgattcccccgatgaggaagaggctcacggtctggtgcccttccctgacactctcatcgccccagagcccgatgaggacgtcacagctagccaggccatcgccttggcggtggaccgcaactggattaccgaggacctagcccgcctcatgagccatatttactgtgacggtatgactggagctgatgcgggtcgtctgcatggctgcgctccagctacggtgcgatctcgatgccgtgatggtcgggccgtgttgcagcgcaacgccgagacgatcctggccgtctgctgatccctctcttgctcatgcctgccgccaccctacccctacctgctagaaacatagccatgtctccagcaacgcatctagcatatcttctagcaattgatctagctaccatatagctgatgatctagctatcatatagctgtgtctccagcccaaaggacagcccaatggcatgcttgccacaggaaggtgcgtcagcctcccgaaatactggaaggagctttaccgtgcaggacatgacctcgaccagaccgattgaccgatccccgttcgaccgcactattgcggtgtggaaccacaaaggcggcacgttcaagacgtccgtcgtggcgaacctgggatacctgttcgccgccggtggcaacaaggtgttgatggtcgacatggacccccaggccaatctcgacattgacttcggtatacccgcgggagaacgtgaacggggcatgggattagccgaggcgctacgtgaggggacggcccttcccccaccgcagcatctcagcgaaaaccttcacctggtcagtggcggcccggccctccacgagttcaccgaccccgcatccttagcggccatcctcgaccgagtcaccaccgcacgctacgacctgctagctcaggcccttgccccgctggcctgggactatgacctcatcttcatcgactccgggccggcccaaactctgctgtcccagaccatccttggagtagcccgctggctggtagtgcccacccgcaccgataacgcctcaatcactggcctcgtcgacgttcaagacgccatcgacggggttgcctcctgcaaccctgaccttcaactactcggcgttgtcctagccggcgtgggggcccgggccacccggatcgccgcagataaacgccacgccatcgacacagtgctgggggcaggaaccgttttcgatgcggtcatccactactccgagaaggtgtccgtgctcgcacgccagcagggcaagaccgtcgccgagctagccaacgactaccacaacacccagcccgcctacacctacctagctaaaggccagaacatccccaacgtcgccaaggcagccgtcagcatcgaaactgattatctgaggctggccaccgagatcagcgaccgcatgttcaccagcgacgagcaggagcctgatcatgactgacgatccgactccatccgagcagaacaaccccaccagcgacgacatgcgcttggccgaagaatgggccaacagcggccgcacagtgggagccctgccgcgccgtcaacggcctcagcgacccacaccccgcaccaccagccaaccccctgtctcgtcccctgacacaccggctccgaaaaaaccccagaagacccccaccagccagcctggccgtcaacggatcaacgtcaccgtctacgttgtgcccgaactccatgagcggctgcgctcccgatcggcggcgacgggggtgacggtctcggatctggtggtgcatgcgttagcgttcgtcgccgatcatgcgggggaggcgatcgccgatgatctgcgcgtcgagacgggccccggcatgggggccggactgttcgatgtgaccccatcgcggccagtaggggtcgccaaaacccagctgggggtgcgaatgacccgccacaacaaggatggtttggaccagctgacccggacgagtggagcccgtgaccgcagccatcttgtgtctgtcgccgtgcgcgactatctcgactccaaccctgtaaagaaaggccgacatgtccgctgatgaaactcctgccgcccggggtgggcgacgctttgatacgaccgtcaagcccaggcgccgtcccatgcttatcgccgccggtatcgccatcgtgatagtcggcgcgctcctcatcactcagttgattcgctccgcccaaaccgagcatcgcgtgct

SEQ ID NO: 303 - DNA, 2632 bp, Propionibacterium acnes
ttggtattggtaggcgatggtgtcaccggttttgttgcggatgacgtcgaagccttcgatgtcggaggggatgtcgtcggcgtcgtagacgacggtggtggtgacggggttggaggccgacatttggccgatggtcacgcgcagcatgtttttcaacgcggaggtgaggattgtcgtggcggtggggtttttgtctgcccagcgtttctcggcgatgtcgatcatgtcttggatggttttgacccatcctcggatgggatcgactttggtcagtttgatcccttcgaggaactcgatgggctgggtgatgggcccatctggtccggcttcggtgtcccagccttcgtcgatggctagtttcagttcggcggtatcgacccatgtttcgtgggtggtgccgggcacgttgggccaaaaccatcctgctcgtcctttggtgcgtttgaccggtagtaggccgatgtcgtcccaccaggatggcacggtgaagcggatgtggtagcgggccgggtgccaggggttgttggtgaacaggtcgcgggcttcggtggcgctgagcagagtggcgggtgcggcaccgatctctccggtcactgatccggcatacatgaatcggccgtcgatgtacacgaagttagggatagggccggcaggcacggtggggcgccagcccttttcgcggtcctcggggttgccgtcgtcgacgcatagttcgtagcggtgctgaggggaggtgtgttggatgagtgcgcccagttcggggtccatcggctccatgcgataggactcgggggtccgtagcttccagaggttgattccttctgctccggggcggtccatgagggcccagtcgcggtcgattctggtggcgatgatgtgggttaattcgcgccatgcccagcgggcctggattggggtgagggtctggccagggaaccattcatcagcgaccagaatgtcgaggttgcggtcggtttctttgtgggtgaaccggcctcgggcgggccgcccggacagcatgaacaggccccgcacgtgccagtcctggttgaactcgcgggtgtgagcgggggtgtcaggcagcagccaggattgaggctggtcggggatgttaccgcagacgatcaggcgtcgggcgttgtggtgtagcgcggttgttagcaggtctgacagggtcgcgtgcttggtgcgtcgtccccccagcactggcaggatctcgtttccggccgcgtcgactccccgggcggtgtcgatgtctagccacactgtttcggggtcggggggccgatgtggggcgggacggcgctgctcctggtcgtctctcatggtttcctcctttgggccagggagcggccggcgtcgagggcgttcatgcgctcgcgttgttcttcgcgtagttggtagacccggcctcgtgacactcctgctgcctcggcgatggtggtggccggcaggtggccgatggcggcagcgtcggcaaggacgtcacgccaggccaggtcaatggttcccagctgggctagagcttcgtcgcggcggcgggtggcatcagccactacggaggcccaccctgtggggtggatggtcttgacgacgattcggttgtggcggatggggccccatgcatcagcggggacttgccagccgtgattggcggcggactcggtgatcttgaggcgtcgctcaggtgcgcgggtgcgggcagtgacgtcggtgttccaggtctggactggtacccacgtcccctctcggatgcgttcgatgacgcacgtggtgacctcgtcggtgactgtgatgaccagacgataatctttcccgtctggagtggttcgatagctgggcatgtcaccctccccccatatgtcaatctaactagacatattttctagcccatctgacacattgtcaaggacaatagacctttcgtgtgaatccaccccgtcaaatgcacactcacgcctcatggcccgccgtgacgccttaacgaaaccaaaccgcttatagaaccgctccgcagcgggcccggagggcttcagttcgagggtgagaccgtgctcgtcggcccattggcagacttgtgtgaggatctgtgagccgtggccttgagtgtgggggacggcgtggacgcacatgagcatggggccgtggcggcgcgctggcggggccacgtaggctccgccatgccagtccggtgtggtctgccaacttcgccatgccgcagcgcgccaacggcgggcctcggtagccaccatgatcaccatgatgatggacagggttacgacgccgactatggccagctcaccctgaccaggccagttcccgcagatgatccagcctcccagcgcccagatgatcatggcttccacgcccgccgcaatcgggacgagtggggcagtacggatgcggcctgccatgatctcggtgatctcgctgcgatgccatgacaaggagaattcccacgactcttgaatcatgctgatgtgtgaacggcttcctcggcctcgctttgccatagcttctctagacggcgctcggctagctcgtcggggcacggcgacagcctgccgcactcggagcagaccccgaagtggcgcgagagagtgatgaccggctcgtcgggagcatgaaccga

SEQ ID NO: 304 - DNA, 2061 bp, Propionibacterium acnes; identical to SEQ ID NO: 205

SEQ ID NO: 305 - DNA, 2219 bp, Propionibacterium acnes
gctgagaaaaattttgggtccgccctgcatatcggggcctcttcataccttcaaaagtgtgaagggaatacagactcttcgactggaattaaaatggtatatggcgtgtccggtccgcacccagctccacgatgcgccatagaggagccataacttcaccaatcgtatacgatatgagtgtaggtgagcatctaccggtggccgacagtcagatacaagcatgggcggatgaagcagaagctgattatgacctcagcatgcttccgccgtctcgacgtggtcgcccaccggtggggaggggcccgggcactgtggtccctgtgcgcttcgacgcggacactctcaaggcgttgtcacaacgagcccctgacgaaggattgaccacgcgttctgacgcgatccgtgctgcggttaaccagtggctcggcctcggctcgtaaacattatcggcgcgacaaccttactgatgacgctgttggttacgccgtagagcacatcttgtactcgtgggcgctcgacgatgccgatgatcctcgttgctggatgatgattcggtgttgacccagctggcctcctcatggagctagttatcctcatctacgacgatggctatgaactcctgatccacgccatgaaagcccgccctcagtatctgagctacttcgctatctagtgttgttgggcgagttgaactcaacttttctccgacgcaagcgccaataaaaggctgatccatccgaataccaccaaacacggctgaagtgtggaacagattcagcaagacagggtgcggtgctcgggtgcgttggggagatgaggatattcaggcttctggcgggatgtggcttgatgacgtccaggatcaccggttcggttttgaaggtgccttgcattaatgtcgacagggtcgtacgactcgaggactggatcgaccagcccgttgcgtctgaagaacttcatccaccccggtggagctccggccgcgtactggtgcaacggatcattagcatgggtagcgtgagtatgccttcgatcgtggtcagtgctgtcatcatccaagattctgacgggcggcttctcactgtccgtaaacgaggcgccgaggcattcatgctgccaggcggcaagccggagcccggcgaggactcgcgtcaggcagtagtccgggaagtgcacgaagagctcggcgtcgcattgtcttccgacgacctgcgtcgggtgggagtgttcaccacgcgagcagcgaatgaggccggccatcaggtggtggcgacgattttcacccacaccccggttgcggtgagtgagccagctgctgagatcgagcagattcgttggctcgattggagtgtcgacgccctgcctgatgacctggccccgctgctggtcgaggcagtcatcccgtggctgcggcgccgtatccggtcggtcgctgtattcacgggtgcgaaggatggaaccgaccctcattatcgtgtcgaagcaaccgccttgggccggggtctcgcacacgccgggatcaccctggtttatggcggcgggaaggtcgggatgatgggtgctgttgctgatgcggccctcgctgctggcggcgctgtgatcggagtgatgccgcagcacttggtggacggggagatcgcccatcctagtctgactcacctcgaggtagtgcggactatgcatgagcgcaagcagcggatgagtgacctagctgacgcgttcgtcgcgctacccggcggcggcggaacccttgacgagctattcgaagcatggacatggcagcagctcggtgtacacagcaaacccgtggccttgtacgactcgaccttctgggcaccgctgaccgcgctactcaaccacatgaccatcgaaggcttcatccgccctgaggaccgcgcctcgctcgtgatcgccgataccatacatcagctgatggccgatcttgagggatggaccccaccaccaccgaagtggcgctcgtgacatagaacaaatgattctgactatggctcattgacatctgcgcagcggctactagctccattgacttcaaatcgggccttggccgaggctcggttcaggtggcccggaatggatccccacaaattgaatgctcatgatcgaggtgatgaacgcccactctattgtcctacgcccggttgtatccagcgagcaattgaaggtgctgcgcctgttggtcgaccaggccgagccactca

SEQ ID NO: 306 - DNA, 2218 bp, Propionibacterium acnes
caccaaccatgcatgaacgcaagatcgcctaccggccagccttcctgcgcgacgtgaagcggctcaaaaacaagcactacaacatgaacacacactcaaatgggcggtaaggtcacgaagtcgacgtggctgcctcacggatggcttcggcgagctcttggggtcgactccacatgggccagtggccggttggcagatccatcgcggtgaagttggtcaggtgcgcgacggcgctgaacatcggattgcctgctgcggccagctcgaggacctggacgctggggatagaacagcagatcaacgtggttagtacatcatggcgagcgctattggacagcgcgacccgtgcccgggccacttgcgcgggttcaggaaccgcccgtgcccggaaccggtcaaggtgctcgttgctgaggccctctaaactggcctgcttgccgagagtatcgaagtcaggaagtggcagctcagctgtttcctcaggtagatctggtgcgaaggcacctccatcgctcatgggaccggagtccacccagacgatccgatggaccaactctgggtgcctgtctacaactaggctcaccggcccgttcgcgccactgtgtcccaccaggaccgcatcgccgcccatctcgtccaggatggctgagatggcgtcagcttggtcgtcgagcgtgcgcgtagtgcgctgggtgtcctccggatcgaggccaggcagcgtcagccccacggctcgactgccagcagtgttcaataactcgactacctcgtcccaagcccaggctccgagccagtaaccaggaacgaggacgataggccgatgctggtcaggtcgcgatgttgaagtcatggagacatagttgcacagtgcgcggacaagggagtggcactatttctggcatgaatttagatctgggtgtccggtgaggcgatcagaacgcctccatgtactgtccgagtgtctaggatgcagcggacacagtcgagcagctggctcacaagtttccaggtgtccttctgcccctatgagggaagtcggctgctctcgcaacctttgagggctgctctggggtcggaaccagttacagatcgttcaagttccgggaactaccgccggtcacgctgattgattcccgggcgatctcgcttctgacgacagtggtcggtgaccgagaggcgtcctactctgaccccgctgctgcggtgagtaaatcacgggcgtcccggatccggccacccgtccaagtgccagccagcttgatcggctaggcatcgtcaaggagcgacgatgaggtgatgatgcgatgtgagcgcaccgcgaagtgaggtataaagaagccttcccgggcgcatgcgtcgcccaggaaggccaggttggcccctggacggctgaatggttgggcggatcaggctgtagcggagacgtgcagtacctcgtaggcgatggcgttggttgggctctggtctgcatcgtggctactgagttcgacgaggatgacggtccaggtggtgatgtcgacggcggtgacgcgggcgatggtggaatcagtggatgctgcaaggaagtcggcggttatgtcttcgatgcagtgggacggagcagtgctggtgggcaggggcacggtcttgacggtcaggcttcgggcagcagagtaatcggcggttccgttaacaagctggtggacggtccagtcctggatcgggtgccggccgaagtcgcgtacgatagccgagtaaccaagttcgccccagcagaactggcgcatcccctctatgtcgcgccagacgtagaagggcgcgtaggagttctggggtgcgcctttgaccttttcttggatgaggtaggccttgaactccagtccatggtagccgtccatgaggtgtccagtctggatgacgcggtcgcggatgatctgcatgtcatagtcggtgggcagggtgatctgatattgcatggcgtacatcagcggttctccttggtttcgtgggagtaggtcgtggggatgacgggttcctgccaatcgatggttgacaagtcgtcggcggcttgttggtaggtagggtggatcattggctgtttgagtgcagcgccatgccagtgtctctggccggcgtcgatccagatggattcgcccttggtcaggtgctggggtgcttgtccttcaatatggaccagggcaacgccgcccgtgacgtagaggccctgtcccttggggtg

SEQ ID NO: 307 - DNA, 578 bp, Propionibacterium acnes
ggcgtgggcggcacgcccggcgtcttccgtggcacgatcggccggatccatggcggcgcgcagctgctgttctgcagccaggcgtccaggtcacggcgggcagcatcgacacccagggcagcctcgacggcttcagggctacgacgctggccgggctggttgaccgcagaccactggtgccgggcgtcgtccagatcatggccggcggcgtcgatgagggcggtggtggcttcggcgcagcatcgcctgatccactccgaacgtgacaggccagctgtctcggcggcactgtcaatgcgcgccaggagagatttcatgggcgctcatctgtagcctccagataggcgttgatgtagcgcagagcctgatccgtcatgtcgatggcggctgcctcggcagacgacacaacgggctgtggatgataagaccacccaacatagacggcgaacatcaatttctcgacagctttcatgaggtccccggcggcaaccgcatccgcctcatcatccgaggagaaccacttcaggtctgaacggctgtacatagcccctaggtcctgatgtgggtcgaggtccttg

SEQ ID NO: 308 - DNA, 2201 bp, Propionibacterium acnes
tccgccctgcatatcggggcctcttcataccttcaaaagtgtgaagggaatacagactcttcgactggaattaaaatggtatatggcgtgtccggtccgcacccagctccacgatgcgccatagaggagccataacttcaccaatcgtatacgatatgagtgtaggtgagcatctaccggtggccgacagtcagatacaagcatgggcggatgaagcagaagctgattatgacctcagcatgcttccgccgtctcgacgtggtcgcccaccggtggggaggggcccgggcactgtggtccctgtgcgcttcgacgcggacactctcaaggcgttgtcacaacgagcccctgacgaaggattgaccacgcgttctgacgcgatccgtgctgcggttaaccagtggctcggcctcggctcgtaaacattatcggcgcgacaaccttactgatgacgctgttggttacgccgtagagcacatcttgtactcgtgggcgctcgacgatgccgatgatcctcgttgctggatgatgattcggtgttgacccagctggcctcctcatggagctagttatcctcatctacgacgatggctatgaactcctgatccacgccatgaaagcccgccctcagtatctgagctacttcgctatctagtgttgttgggcgagttgaactcaacttttctccgacgcaagcgccaataaaaggctgatccatccgaataccaccaaacacggctgaagtgtggaacagattcagcaagacagggtgcggtgctcgggtgcgttggggagatgaggatattcaggcttctggcgggatgtggcttgatgacgtccaggatcaccggttcggttttgaaggtgccttgcattaatgtcgacagggtcgtacgactcgaggactggatcgaccagcccgttgcgtctgaagaacttcatccaccccggtggagctccggccgcatactggtgcaacggatcattagcatgggtagcgtgagtatgccttcgatcgtggtcagtgctgtcatcatccaagattctgacgggcggcttctcactgtccgtaaacgaggcgccgaggcattcatgctgccaggcggcaagccggagcccggcgaggactcgcgtcaggcagtagtccgggaagtgcacgaagagctcggcgtcgcattgtcttccgacgacctgcgtcgggtgggagtgttcaccacgcgagcagcgaatgaggccggccatcaggtggtggcgacgattttcacccacaccccggttgcggtgagtgagccagctgctgagatcgagcagattcgttggctcgattggagtgtcgacgccctgcctgatgacctggccccgctgctggtcgaggcagtcatcccgtggctgcggcgccgtatccggtcggtcgctgtattcacgggtgcgaaggatggaaccgaccctcattatcgtgtcgaagcaaccgccttgggccggggtctcgcacacgccgggatcaccctggtttatggcggcgggaaggtcgggatgatgggtgctgttgctgatgcggccctcgctgctggcggcgctgtgatcggagtgatgccgcagcacttggtggacggggagatcgcccatcctagtctgactcacctcgaggtagtgcggactatgcatgagcgcaagcagcggatgagtgacctagctgacgcgttcgtcgcgctacccggcggcggcggaacccttgacgagctattcgaagcatggacatggcagcagctcggtgtacacagcaaacccgtggccttgtacgactcgaccttctgggcaccgctgaccgcgctactcaaccacatgaccatcgaaggcttcatccgccctgaggaccgcgcctcgctcgtgatcgccgataccatacatcagctgatggccgatcttgagggatggaccccaccaccaccgaagtggcgctcgtgacatagaacaaatgattctgactatggctcattgacatctgcgcagcggctactagctccattgacttcaaatcgggccttggccgaggctcggttcaggtggcccggaatggatccccacaaattgaatgctcatgatcgaggtgatgaacgcccactctattgtcctacgcccggttgtatccagcgagcaattgaaggtgctgcgcctgttggtcgaccaggccgagccactca

SEQ ID NO: 309 - DNA, 2334 bp, Propionibacterium acnes
cccgcggcgtccgctggggcgagtgcgtgtctgtcatctcatcttttatcgtcatgtttccccttgtcagaggggtctttgcaaagtgacaacgtcaggggtcttgacgacaacatcctcgacaacatcgtggcggtggtctgtgtcttgtcagttcaacgcaccggggaaagaggcaccgctgatgttcaccaccacaaacaccctcaacgatgaatgggaccagattcgcgccatcgagatcgattggcatgactgccctgaactgatgcactgcatcgacgttgatgatgtgttggccgtcattcctgccgcccccgacgccatcttgggctacctcattgcccgggctcagggcggtgacgagttggccacccgcactatcatccaagcgttcacaggcaagcttattttgatggccacggccaccaaggtgcgccgtactaatgacggcttcaatgatctgttggcgggtctgtgggagacgatcatcacttacccgttggatcgtcgccctgacaagatcgctgcgaacctcatcctcgacacgttgcaccgggttacccggttttggcgtgctgattcccccgatgaggaagaggctcacggtctgctgcccttccctgacactctcatcgccccagagcccgatgaggacgtcacagctagccaggccatcgccttggcggtggaccgcaactggattaccgaggacctagcccgcctcatgagccatatttactgtgacggtatgactggagctgatgcgggtcgtctgcatggctgcgctccagctacggtgcggtctcgatgccgtgatggtcgggccgtgttgcagcgcaacgccgagacgatcctggccgtctgctgatccctctcttgctcatgcctgccgccaccctacccctacctgctagaaacatagccatgtctccagcaacgcatctagcatatcttctagcaatttatctagctatgtatatagctgatgatctagctatcatatagctgtgtctccagcccaaatgacagcccaatggcatgcttgccacaggaaggtgcgtcagcctcccgaaatactggaaggagctttagcgtgcaggacatgaccagtcctattgaccgatccccgttcgaccgcactattgcggtgtggaaccacaaaggcggcacgttcaagacgtccgtcgtggcgaacctgggatacctgttcgccgccggtggcaacaaggtgctgctggtcgacatggacccccaagccaatctcgacatcgacttcggtatacccgcaggagaacgtgaacggggcatgggattagccgaggcgctgcgcgaggggacggcccttcccccaccacagcatctcagcgaaaacctccacctggtcagtggcggcccggccctccacgagttcaccgaccccgcatccttagcggccatcatcgaccgagtcaccaccgcacgctacgacctgctagctcaggcccttgccccgctggcctgggactatgacctcatcttcatcgactccgggcctgcccaaactctgctgtcccagaccatccttggagtagcccgctggctggtagtgcccacccgcaccgataacgcctcaatcactggcctcgtcgacgttcaagacgccatcgacggggttgcctcctgcaaccctgaccttcaactactcggcgttgtcctagccggcgtgggggcccgggccacccggatcgccgcagataaacgccacgccatcgacacagtgctgggggcaggaaccgttttcgatgcggtcatccactactccgagaaggtgtccgtgctcgcacgccagcagggcaagaccgtcgccgagctagccaacgagtaccacaacacccagcccgcctacacctacctagctaaaggccagaacatccccaacgtcgccaaggcagccgtcagcatcgaaactgattatctgaggctggccaccgagatcagcgaccgcatgttcaccagcgacgagcaggagcctgatcatgactgacgatccgactccatccgagcagaacaaccccaccagcgacgacatgcgcttggccgaagaatgggccaacagcggccgcacagtgggagccctgccgcgccgtcaacggcctcagcaacccacaccccgcaccaccagccaaccccctgtctcgtcccctgacacaccggctccgaaaaaaccccagaagacccccaccagccagcctggccgtcaacggatcaacgtcaccgtctacgttgtgcccgaactccatgagcggctgcgctcccgatcggcggcgacgggggggacggtctcggatctgg

SEQ ID NO: 310 - DNA, 2280 bp, Propionibacterium acnes
gacgccggccaccccaactactccgacccacacggtgaccccagctccggcctctgccggccactcgaccagcgacgagcacccaatccatacggataccgccgcagcggacaaggccagcgacgaggacgccctgtccccaatccaggtgggtttgaccgccagcgtcggactggtgctggtcgccggactgatcaccaccctcaaccgccgctaccggacccggttcacccgccagccccgcggcaaggccatgaccctgcccagcccggacgcccaaactgccgagatagcgctgcgcagcaccggggcgactgacactctgacgatcacctgcctcgaccaggcgctccgcgcgatcggcgcatggtgccaccactgcgggcacccgctgccacccctgctggccgcccgcgtcgatgacgaccggatcgacctgctgctatcccaggcggcccccgaccatcccgaggcggtggagctggccgccgacggatcggtgtggaccctcaccgccgaccggatcgacgacctgctagcccacaccgatgacaaccaagcggctccgtggccgtctctggtcacactgggacgcgacgacgacggcgcccacatcctcatcgacttggaagccgcaggaaccttgcacctgatcgccgatgacgaccaggtcgacgcggccctcgccgcgatcgccgtggaactggccacctgtgactggtccgacgaggtcaacgtcaccctggtcggccaggtgtgcccgggcctagaagacgcactagagtctccgaccctgacccgcgccaccgacgtggacgccctcctcaccaccctggaagctcgcgccgacgaccagcgacacatcctcaccgaaggaagccccctcgccgctcaccgagccgaccccgccatctccgacgggttcgacgccgaagtgatcctcctcgacaccgaactcaccgaagaccaccgcaaccgcctcgccagcctcgtcgaggctcttccccgcgtgtcagtcgccgcggtaacaaccagccccaccagcccagacgaatggtccctcaccctgacaggtgacccactagccgccgacctggctcccctcggctggcacatccacccccaaaccctctcccccgacctgtacaaccgcatggttgaactactcgccaactccgccgccgcagactacgaacccgccagctggtggaaccacgacgccgacgacgagcccaccaccgaccccaccaacgaggaagaatctaccccgagcaggcgagcccgcccgaatatccgcctgaccaccctgaccggcggcatcgacctatccagcgtcgacatcgacgacatcatcgacgaagccaaccaggccctcgacaacaccgaccagaccaccaaccaggttcgcgtcgacaccgaccaacccggcaccgacacccccttccccatcgacgacatcgacccgctgagctccgaccacccggtcctatccatcatcggccaccccgacatcacaggtgccactggaaccgttgggcgctccccgtggcgctgccaacagttggccctctacatcgctgagcatccgggagcatcgggggcgactatcgccgatgatttggggctatcagcgtcgacggtgcgctcgattgctacacacctgcgacactggttgggagccgacgatgccggggtggcttacatgccggcggcgacgcgcggctaccggctcgatgagcggatcgtcacagatgtggacctgatcgacgctgctgtggccggggcaggcattaacaccgctgagacggccacactggtggccattttgaagctgggccgcggacgggtcttcgctggggttcctgactcggaacttcgccagttcagggcgtcgatgtaccacgtggaggcccgcatcgtcgatgctgccctccaagtgacagaccgggccctggaagccggagacttggggctggcccggtgggcgctgacccaagggctactggtgtctcccgatcatgaggacctggtcgccggttgtctgcgcaccgaataccaggccggcaacatggacaaggtcgccgagctagttgatcacctgtcggctaccgcacgccgactgggcgtcgacctcaacgaggacaccacccggatcatcgatacggtcacccacgccgacaggagagcatcatgatctcccctgcactcatctccgtcaggaaggtccctatgcaccattatcgtcttggtatcggcactgccctcatcgccgtagcagcc

SEQ ID NO: 311 - DNA, 594 bp, Propionibacterium acnes
gctgagaaaaattttgggtccgccctgcatatcggggcctcttcataccttcaaaagtgtgaagggaatacagactcttcgactggaattaaaatggtatatggcgtgtccggtccgcacccagctccacgatgcgccatagaggagccataacttcaccaatcgtatacgattggagtgtaggtgagcatctaccggtggccgacagtcagatacaagcatgggcggatgaagcagaagctgattatgacctcagcatgcttccgccgtctcgacgtggtcgcccaccggtggggaggggcccgggcactgtggtccctgtgcgcttcgacgcggacactctcaaggcgttgtcacaacgagcccctgacgaaggattgaccacgcgttctgacgcgatccgtgctgcggtttaaccagtggctcggcctcggctcgtaaacattatcggcgcgacaaccttactgatgacgctgttggttacgccgtagagcacatcttgtactcgtgggcgctcgacgatgccgatgatcctcgttgctggatgatgattcggtgttgacccagctggcctcctcatggagctagttatcc

SEQ ID NO: 312 - DNA, 2594 bp, Propionibacterium acnes
ttggtattggtaggcgatggtgtcaccggttttgttgcggatgacgtcgaagccttcgatgtcggaggggatgtcgtcggcgtcgtagacgacggtggtggtgacggggttggaggccgacatttggccgatggtcacgcgcagcatgtttttcaacgcggaggtgaggattgtcgtggcggtggggtttttgtctgcccagcgtttctcggcgatgtcgatcatgtcttggatggttttgacccatcctcggatgggatcgactttggtcagtttgatcccttcgaggaactcgatgggctgggtgatgggcccatctggtccggcttcggtgtcccagccttcgtcgatggctagtttcagttcggcggtatcgacccatgtttcgtgggtggtgccgggcacgttgggccaaaaccatcctgctcgtcctttggtgcgtttgaccggtagtaggccgatgtcgtcccaccaggatggcacggtgaagcggatgtggtagcgggccgggtgccaggggttgttggtgaacaggtcgcgggcttcggtggcgctgagcagagtggcgggtgcggcaccgatctctccggtcactgatccggcatacatgaatcggccgtcgatgtacacgaagttagggatagggccggcaggcacggtggggcgccagcccttttcgcggtcctcggggttgccgtcgtcgacgcatagttcgtagcggtgctgaggggaggtgtgttggatgagtgcgcccagttcggggtccatcggctccatgcgataggactcgggggtccgtagcttccagaggttgattccttctgctccggggcggtccatgagggcccagtcgcggtcgattctggtggcgatgatgtgggttaattcgcgccatgcccagcgggcctggattggggtgagggtctggccagggaaccattcatcagcgaccagaatgtcgaggttgcggtcggtttctttgtgggtgaaccggcctcgggcgggccgcccggacagcatgaacaggccccgcacgtgccagtcctggttgaactcgcgggtgtgagcgggggtgtcaggcagcagccaggattgaggctggtcggggatgttaccgcagacgatcaggcgtcgggcgttgtggtgtagcgcggttgttagcaggtctgacagggtcgcgtgcttggtgcgtcgtccccccagcactggcaggatctcgtttccggccgcgtcgactccccgggcggtgtcgatgtctagccacactgtttcggggtcgggggccgatgtggggcgggacggcgctgctcctggtcgtctctcatggtttcctcctttgggccagggagcggccggcgtcgagggcgttcatgcgctcgcgttgttcttcgcgtagttggtagacccggcctcgtgacactcctgctgcctcggcgatggtggtggccggcaggtggccgatggcggcagcgtcggcaaggacgtcacgccaggccaggtcaatggttcccagctgggctagagcttcgtcgcggcggcgggtggcatcagccactacggaggcccaccctgtggggtggatggtcttgacgacgattcggttgtggcggatggggccccatgcatcagcggggacttgccagccgtgattggcggcggactcggtgatcttgaggcgtcgctcaggtgcgcgggtgcgggcagtgacgtcggtgttccaggtctggactggtacccacgtcccctctcggatgcgttcgatgacgcacgtggtgacctcgtcggtgactgtgatgaccagacgataatctttcccgtctggggtggttcggtagctgggcatgtcaccctcccctatctgtcaaatgagctagacacagtgtctatttaatttgacgcaaagtcaagtgtgctagacgcctttgtgtggatccgcccgcccagacaggcactcacgtctcatgacccgccgcgacgtcttaacgaaaccaaaccgcttatagaaccgctccgcagcgggcccggagggcttcagttcgagggtgagaccgtgctcgtcggcccattggcagacttgtgtgaggatctgtgagccgtggccttgagtgtgggggacggcgtggacgcacatgagcatggggccgtggcggcgcgctggcggggccacgtaggctccgccatgccagtccggtgtggtctgccagcttcgccatgtcgcggtacgccagtggtgggcttcgagggccaccatgatcaccgcgacgacgacgagcgttgcggccccgatcatggccagctcaccctgaccaggccagttcccgcagatgatccagtctcttaacgcccagatgatcgcggcttccacgcctgctgcgatcgggatgagcaaggcagaacgaaggtgtcctgccatgatctcggtgatctcgctgcgatgccatgacaaggagaattcccacgactcttgaatcatgctgatgtgtgaacggcttcttcggcttcgccctgccatagtttctccaaacgacgctcagccagctcgtcgggacacggcgacagcctgccgcactcggagcagaccccgaagtggcgcg

SEQ ID NO: 313 - DNA, 2383 bp, Propionibacterium acnes
tggttgtcgaccacaacgatggttcccggtcaacgctgccgccggtggccgactcggatgccgagctggaatcccagatcgcccggatggcgaggaatgcgaccccgcggcgagccttcgacgccgatcacaccgatgtgacgatcatgcaccaacagaagttccgtatccacgcgatctcagcggaagtgtcattgcaaccgtcggtggtcatccgccaacatttgctcacccaaatcagtctgggggacctgtcacatcgcggaatgatgccggtggaagtggcccggttcctcgatgaggcggtacaagctggcaagtccatcgtggtcgccggcgagcagggtgcaggcaagacgacgtttttacgagcgttgatccacgccattccgatgcgggagcggttcgccacgttggagaccgatcaggagttgttcgctcatctgatgcctggccgggaaaacacgctggtgctgttcgcccgtgatggtaacggcgaggtggatccggcgactggcacccagcacggcgctatcgagatcgcccagctgattcctcctagcctgcgccaggcgttaactagggtcattgtcggtgaggtgcgcggcaatgaggcctcggccatgttccaggccatgcagtcgggtacaggcaccatgagcagtatccactccccgcgagcctctgaggtgccgtcccggctagcccaaatgatttcgatgggcccggtctacgatctggatcaggccatgctgcagatcggtcattcgatcgactacatcgtctttgttcgtaagcgtgacctgcctgatgggagccggctgcgatttgttgagcagatccgttcagtctcgcctggtgattcgacaactcccagtcttggcgaggtgtacacggctgactcgtggacaggccagccgcttacgccactcatgcccggatcggccgccgacgagctgtctcacttcgcccgagacctggattactgcgaggcccactcatgaacactcccgcactaaccagcgccctcatcgtgaccgggttggggctgatcctggccatcgacgggctggtcccggcgccgcctcgacctggggccccgctgagcccggaccaaaggtgggccaggctcacccaccgtcccacaggagcggccgggcgccgccgggacctgcgctgggggctggctgttctcgtcggcgtcgtgctgtttgtgctcaccgggtgggtcgctgcgctggcgttgggccccatcatcgtgctgctggcccccaccctgctgggggcggccccaccaaccgacatcccgctgatggaggcgctggatcggtgggtgcgtcaggtcgctgcggtgctgccacaggggcgagacatcatcacagcggtgcggatctcacggccgcgggccccgaagctgatcgccgggtcggtggatcaactggtgtcccggttggatggccgtatggagccgagggaggcgttccagcggatggccgacgagctggactcggctgaggctgacgcggtgctggcctcactagcgttggcggccactcacccgcggggagcctcgacaacgttgaaggctattgctggcaacatccaacagcggttgaaagtgctgcggcaggtggaggctgagcggtctaagccgcgtaactcggtgcgccagatcacactggtcacgatcgccatgttcggggggctgctcgtgatcggacggtcgtttctggccccgctggcgacccctcccggtcaggtgctggtggccgtggcggtggtcatgtatgtcatcgcactagtgcagatgtatcggatggcgcggccccgtcgacgcacccggatcatggtcaggaggacccgatgaccattactgctttgtccctgctggccggggccatcgtcactgtcggactgctggtcatcgtggcagcgttccgcccagccccaggccctgacctggttgccgctctggaggtggtgtcgggtcgcacctcaagcgtcgccgagaacgtcgaccagacccggatcgggcggataggtcgcagcgtgacccgcacattccatgtgtcggtgtccccggccatgcgggccgcactgcgactccaaggcacgacccccgaagcgttctacggtcgacgcctgatctgcgcactgatcggggcgatcctgccgtggctgctcaacgcggtagccatcgcggtaggggcgaattccccgaacctactcatcccttcggcgctgtgtgtggcgttagctggcgctggatggatgctgccggcagcacggttgaaggctgcggccgggcccaccaacgatgactcgttcgaagcgctgctggtattcatcgatttggtcgtgctggaacggctcgccaacgaaa

SEQ ID NO: 314 - DNA, 2238 bp, Propionibacterium acnes
gacgccggccaccccaactactccgacccacacggtgaccccagctccggcctctgccggccactcgaccagcgacgagcacccaatccatacggataccgccacagcggacaaggccagcgacgaggacgccctgtccccaatccaggtgggcttgaccgccagcgtcggactggtgctggtcgccggactgatcaccaccctcaaccgccgctaccggacccggttcacccgccagccccgcggcaaggccatgaccctgcccagcccggacgcccaaactgccgagatagcgctgcgcagcaccggggcgactgacactctgacgatcacctgcctcgaccaggcgctccgcgcgatcggcgcatggtgccaccactgcgggcacccgctgccacccctgctggccgcccgcgtcgatgacgaccggatcgacctgctgctatcccaggcggcccccgaccatcccgaggcggtggagctggccgccgacggatcggtgtggaccctcaccgccgaccggatcgacgacctgctagcccacaccgatgacaaccaagcggctccgtggccgtctctggtcacactgggacgcgacgacgacggcgcccacatcctcatcgacttggaagccgcaggaaccttgcacctgatcgccgatgacgaccaggtcgacgcggccctcgccgcgatcgccgtggaactggccacctgtgactggtccgacgaggtcaacgtcaccctggtcggccaggtgtgcccgggcctagaagacgcactagagtctccgaccctgacccgcgccaccgacgtggacgccctcctcaccaccctggaagctcgcgccgacgaccagcgacacatcctcaccgaaggaagccccctcgccgctcaccgagccgaccccgccatctccgacgggttcgacgccgaagtgatcctcctcgacaccgaactcaccgaagaccaccgcaaccgcctcgccagcctcgtcgaggctcttccccgcgtgtcagtcgccgcggtaacaaccagccccaccagcccagacgaatggtccctcaccctgacaggtgacccactagccgccgacgtggctcccctcggctggcacatccacccccaaaccctctcccccgacctgtacaaccgcatggttgaactactcgccaactccgccgccgcagactacgaacccgccagctggtggaaccacgacgccgacgacgagcccaccaccgaccccaccaacgaggaagaatctaccccgagcaggcgagcccgcccgaatatccgcctgaccaccctgaccggcggcatcgacctatccagcgtcgacatcgacgacatcatcgacgaagccaaccaggccctcgacaacaccgaccaggccaccaaccaggttcgtgtcgacaccgaccaacccggcaccgacacccccttccccatcgacgacatcgacccgctgagctccgaccatccggtcctatccatcatcggccaccccgacatcacaggtgccactggaaccgttgggcgctccccgtggcgctgccaacagttggccctctacatcgctgagcatccgggggtatcgggggcgactatcgccgatgatttggggctatcagcgtcgacggtgcgctcgattgctacacacctgcgacactggttgggagccgacgatgccggggtggcttacatgccggcggcgacgcgcggctaccggctcgatgagcggatcgtcacagatgtggacctgatcgacgctgctgtggccggggcaggcattaacaccgctgagacggccacactggtggccattttgaagctgggccgcggacgggtcttcgctggggttcctgactcggaacttcgccagttcagggcgtcgatgtaccacgtggaggcccgcatcgttgatgcggctcttcaggtgacggatcgggctctggaagccggggacttggggctggcccggtgggcgttgacccaagggctactggtgtctcccgatcatgaggacctggtcgccggttgtctgcgcaccgagtaccaggccggcaacatggacaaggtttccgagctggtcgatcacctgtcggctaccgcacgacgcctgggcgtcgatttgagcgccgacaccacccggatcatcgatacggtcacccacgccgacaggagagcgtcatgatctcccctgcactcatctccgtcaggaaggttcctatgcaccat

SEQ ID NO: 315 - DNA, 2099 bp, Propionibacterium acnes
gacgccggccaccccaactactccgacccacacggtgaccccagctccggcctctgccggccactcgaccagcgacgagcacccactccatacggataccgccgcagcggacaaggccagcaacgaggacgccctgtccccaatccaggtgggtttgaccgccagcgtcggactggtgctggtcgccggactgatcaccaccctcaaccgccgctaccggacccggttcacccgccagccccgcggcaaggccatgaccctgcccagcccggacgcccaaactgccgagatagcgctgcgcagcaccggggcgactgacactctgacgatcacctgcctcgaccaggcgctccgcgcgatcggcgcatggtgccaccactgcgggcacccgctgccacccctgctggccgcccgcgtcgatgacgaccggatcgacctgctgctatcccaggcggcccccgaccatcccgaggcggtggagctggccgccgacggatcggtgtggaccctcaccgccgaccggatcgacgacctgctagcccacaccgatgacaaccaagcggctccgtggccgtctctggtcacactgggacgcgacgacgacggcgcccacatcctcatcgacttggaagccgcaggaaccttgcacctgatcgccgatgacgaccaggtcgacgcggccctcgccgcgatcgccgtggaactggccacctgcgactggtccgacgaagtcaacgtcaccctcgtcggccaggtgtgcccgggcctagaagacgcactagagtctccgaccctgacccgcgccaccgacgtggacaccctcctcaccaccctagaagctcgcgccgacgaccagcgacacatcctcaccgaaggaaaccccctcgccgctcaccgagccgaccccgccatctccgacgggttcgacgccgaagtgatcctcctcgacaccgaactcaccgaagaccaccgcaaccgcctcgccagcctcgtcgaggctcttccccgcgtgtcagtcgccgcggtaacaaccagccccaccagcccagacgaatggtccctcaccctgacaggtgacccactagccgccgacctggctcccctcggctggcacatccacccccaaaccctctcccccgacctgtacaaccgcatggttgaactactcgccaactccgccgccgcagactacgaacccgccagctggtggaaccacgacgccgacgacgagcccaccaccgaccccaccaacgaggaagaatctaccccgagcaggcgagcccgcccgaatatccgcctgaccaccctgaccggcggcatcgacctatccagcgtcgacatcgacgacatcatcgacgaagccaaccaggccctcgacaacaccgaccagaccaccaaccagaccaccaaccaggttcgcgtcgacaccgaccaacccggcaccgacacccccttccccatcgacgacatcgacccgctgagctccgaccacccggtcctatccatcatcggccaccccgacatcacaggtgccgctggaaccgttgggcgctccccgtggcgctgccaacagttggccctctacatcgctgagcatccgggagcatcgggggcgactatcgccgatgatttggggctatcagcgtcgacggtgcgctcgattgctacacacctgcgacactggttgggagccgacgatgccggggtggcttacatgccggcggcgacgcgcggctaccggctcgatgagcggatcgtcacagatgtggacctgatcgacgctgctgtggccggggcaggcattaacaccgctgagacggccacactggtggccattttgaagctgggccgcggacgggtcttcgctggggttcctgactcggaacttcgccagttcagggcgtcgatgtaccacgtggaggcccgcatcgtcgatgctgccctccaagtgacagaccgggccctggaagccggagacctggggctggcccggtgggcgctgacccaagggctactggtgtctcccgatcatgaggacctggtcgccggttgtctgcgcaccgaataccaggccggcaacatggacaaggttgccgagc

SEQ ID NO: 316 - DNA, 2126 bp, Propionibacterium acnes
tgggctgtagaggaggtcgatgtcgcgggcagggtcgtcgggttcttcggttacctcgggtggggtcgatctggctgtctcggtgtcgtcggccaggtcggctcccaggatgcgttcccattcggggctggttttcttgcccgctgaggccatcgtctcgtcgatctgttcgtcagtgggccacacaaatttctttttggtccaggtcgtggtgtcgggtcgcagctgatccagcagttccaggtcttgcggggagtgggccttgcgggggtcgggggtgtagaagaattggacttccttgggggctgattcgccggataggtaggtgccgcggccgcgtttgccgaacgggattcccacgccgacgtgttcggagccgaacatcatgcgggctccgtcagcggacaggggtccggtggcggcacgcccggagaagttgtctcggatttcgccgcccaggaactcggcgtcggggcgttgggtccccagatcgacgtggatacggcaggcggctgccatgcgcagcagggagccgatccagccgaaaacggggcattctccgggcatcccagagaccttgatcgttgaccaccagtttttcgcgttgccgtagaactggcggtactcgtcgatgaggaccagcacgcgggtgaagtcggtctcgcgggccccttcttcttcgatgcggcggtagcggtcctccatgagagaccacagccagtggatgagggcgacctggtcggggacggtagtggcgaccatctcgatgttgggccactcccgcaggcccaggtactcgatgcgtttagggtcgatgacgaagacgcgccagttgcggcgggcaccctcgacggcgtcgccgatcatggacaccgtttttccggtacgggtgcggccggccttgagctggtgggccatgacaccggagatgtcccagaaacaggtgttgccgtcctcgtcgacggcctgggggattttctcccagtctggggagtctgggcccggaagggccacgggtcggggcaccatcgagggcagggggtggcggcgggtgacggtgatggtgtcgtgttccaggtcgaagtcgctgcgccactggccgagcatcatcgccgaggtcaccgcggccaggcgcaattggatgttcgggctggacaaatgggcgccacgttggtggtgaatggtgaagccgtccaggttcccccgatcggttttccaggaatcgacggtgaccgccgacccatagatctgagtggctacttctttagcccgttccttgtctcggtccagatcggttttgtcagggtcaggggtcggggcgcggtattgcaggacgaaccggcccgccgggatcgttgcggatgtcaccgtgaactctgccggcgaccaggcagccgcggccgcctgggtgagggccattggcatggtctcgacggcagcctcctcgggggggatggtgagggtcaggcgtcgcggatgcgtcttcttgcgattccatgtgactttctgcctcaccggcaccttcgccgccgactgaatggctaggcgagctgattcggcagtttcggtacgccggccagcgcgtagcgcccgtcgtgcgtgaaggctgcccaccacagcacagcccatacacggcagccaccagcgcggatcagcggctgctgcatagcccccggtagctagtaccgcacctgaccagccggccgcgatacttttccacgccggtttcgcaccaacagtcggggcagacgctggccgcttcgagaccgaggagggacgagacaagggagtgctggtcatgccgcggcctccttgtggcaggtcatttcacaggcatgccggccagcgatgatgccgtggcgcaccgccccggtagccgcatagaccgcgcacaactcaaacacggggcacccatcgcaggccgccgggttcatgctttctttgtcccacgatggtgggtcatcggtgcacggcacggccaggccatcctgttgagcggcgctgatagcggtgaataggcgcagctgggcgcgaacttggtctggggtcaggttgacggtgcgggctacacgcatggggttccttcctcttcaccagtgaaggttccctagacccggccgatgtgc

SEQ ID NO: 317 - DNA, 1956 bp, Propionibacterium acnes
ccgccgtctcgacgtggtcgcccaccggtggggaggggcccgggcactgtggtccctgtgcgcttcgacgcggacactctcaaggcgttgtcacaacgagcccatgacgaaggattgaccacgcgttctgacgcgatccgtgctgcggttaaccagtggctcggcctcggctcgtaaacattatcggcgcgacaaccttactgatgacgctgttggttacgccgtagagcacatcttgtactcgtgggcgctcgacgatgctgatgatcctcgttgctggatgatgattcggtgttgacccagctggcctcctcatggagctagttatcctcatctacgacgatggctatgaactcctgatccacgccatgaaagcccgccctcagtatctgagctacttcgctatctagtgttgttgggcgagttgaactcaacttttctccgacgcaagcgccaataaaaggctgatccatccgaataccaccaaacacggctgaagtgtggaacagattcagcaagacagggtgcggtgctcgggtgcgttggggagatgaggatattcaggcttctggcgggatgtggcttgatgacgtccaggatcaccggttcggttttgaaggtgccttgcattaatgtcgacagggtcgtacgactcgaggactggatcgaccagcccgttgcgtctgaagaacttcatccaccccggtggagctccggccgcgtactggtgcaacggatcattagcatgggtagcgtgagtatgccttcgatcgtggtcagtgctgtcatcatccaagattctgacgggcggcttctcactgtccgtaaacgaggcgccgaggcattcatgctgccaggcggcaagccggagcccggcgagaactcgcgtcaggcagtagtccgggaagtgcacgaagagctcggcgtcgcattgtcttccgacgacctgcgtcgggtgggagtgttcaccacgcgagcagcgaatgaggccggccatcaggtggtggcgacgattttcacccacaccccggttgcggtgagtgagccagctgctgagatcgagcagattcgttggctcgattggagtgtcgacgccctgcctgatgacctggccccgctgctggtcgaggcagtcatcccgtggctgcggcgccgtatccggtcggtcgctgtattcacgggtgcgaaggatggaaccgaccctcattatcgtgtcgaagcaaccgccttgggccggggtctcgcacacgccgggatcaccctggtttatggcggcgggaaggtcgggatgatgggtgctgttgctgatgcggccctcgctgctggcggcgctgtgatcggagtgatgccgcagcacttggtggacggggagatcgcccatcctagtctgactcacctcgaggtagtgcggactatgcatgagcgcaagcagcggatgagtgacctagctgacgcgttcgtcgcgctacccggcggcggcggaacccttgacgagctattcgaagcatggacatggcagcagctcggtgtacacagcaaacccgtggccttgtacgactcgaccttctgggcaccgctgaccgcgctactcaaccacatgaccatcgaaggcttcatccgccctgaggaccgcgcctcgctcgtgatcgccgataccatacatcagctgatggccgatcttgagggatggaccccaccaccaccgaagtggcgctcgtgacatagaacaaatgattctgactatggctcattgacatctgcgcagcggctactagctccattgacttcaaatcgggccttggccgaggctcggttcaggtggcccggaatggatccccacaaattgaatgctcatgatcgaggtgatgaacgcccactctattgtcctacgcccggttgtatccagcgagcaattgaaggtgctgcgcctgttggtcgaccaggccgagccactca

SEQ ID NO: 318 - DNA, 2383 bp, Propionibacterium acnes
ttggtattggtaggcgatggtgtcaccggttttgttgcggatgacgtcgaagccttcgatgtcggaggggatgtcgtcggcgtcgtagacgacggtggtggtgacggggttggaggccgacatttggccgatggtcacgcgcagcatgtttttcaacgcggaggtgaggattgtcgtggcggtggggtttttgtctgcccagcgtttctcggcgatgtcgatcatgtcttggatggttttgacccatcctcggatgggatcgactttggtcagtttgatcccttcgaggaactcgatgggctgggtgatgggcccatctggtccggcttcggtgtcccagccttcgtcgatggctagtttcagttcggcggtatcgacccatgtttcgtgggtggtgccgggcacgttgggccaaaaccatcctgctcgtcctttggtgcgtttgaccggtagtaggccgatgtcgtcccaccaggatggcacggtgaagcggatgtggtagcgggccgggtgccaggggttgttggtgaacaggtcgcgggcttcggtggcgctgagcagagtggcgggtgcggcaccgatctctccggtcactgatccggcatacatgaatcggccgtcgatgtacacgaagttagggatagggccggcaggcacggtggggcgccagcccttttcgcggtcctcggggttgccgtcgtcgacgcatagttcgtagcggtgctgaggggaggtgtgttggatgagtgcgcccagttcggggtccatcggctccatgcgataggactcgggggtccgtagcttccagaggttgattccttctgctccggggcggtccatgagggcccagtcgcggtcgattctggtggcgatgatgtgggttaattcgcgccatgcccagcgggcctggattggggtgagggtctggccagggaaccattcatcagcgaccagaatgtcgaggttgcggtcggtttctttgtgggtgaaccggcctcgggcgggccgcccggacagcatgaacaggccccgcacgtgccagtcctggttgaactcgcgggtgtgagcgggggtgtcaggcagcagccaggattgaggctggtcggggatgttaccgcagacgatcaggcgtcgggcgttgtggtgtagcgcggttgttagcaggtctgacagggtcgcgtgcttggtgcgtcgtccccccagcactggcaggatctcgtttccggccgcgtcgactccccgggcggtgtcgatgtctagccacactgtttcggggtcggggggccgatgtggggcgggacggcgctgctcctggtcgtctctcatggtttcctcctttgggccagggagcggccggcgtcgagggcgttcatgcgctcgcgttgttcttcgcgtagttggtagacccggcctcgtgacactcctgctgcctcggcgatggtggtggccggcaggtggccgatggcggcagcgtcggcaaggacgtcacgccaggccaggtcaatggttcccagctgggctagagcttcgtcgcggcggcgggtggcatcagccactacggaggcccaccctgtggggtggatggtcttgacgacgattcggttgtggcggatggggccccatgcatcagcggggacttgccagccgtgattggcggcggactcggtgatcttgaggcgtcgctcaggtgcgcgggtgcgggcagtgacgtcggtgttccaggtctggactggtacccacgtcccctctcgggcgcgttcgatgacgcacgtggtgacctcgtcggtaaccgtgatgaccagacgataatctttcccgtctggggtggttcggtagctgggcatgtcaccctcccctatctgtcaaatgagctagacacagtgtctatttaatttgacgcaaagtcaagtgtgctagacgcctttgtgtggatccgcccgcccagacaggcactcacgtctcatgacccgccgcgacgtcttaacgaaaccaaaccgcttatagaaccgctccgcagcgggcccggagggcttcagttcgagggtgagaccgtgctggtcggcccattggcagacttgtgtgaggatctgtgagccgtggccttgagtgtgggggacggcgtggacgcacatgagcatggggccgtggcggcgcgctggcggggccacgtaggctccgccatgccagtccggtgtggtctgccagcttcgccatgtcgcggtacgccagtggtgggcttcgagggccaccatgatcaccgcgacgacgacgagcgttgcggccccgatcatggccagctcaccctgaccaggccagttcccgcagatgatccagtctcttaacgcccagatgatcgcggcttccacgcctgctgcgatcggga

SEQ ID NO: 319 - DNA, 718 bp, Propionibacterium acnes
ccggggccctgctgctggtgtgggacgtcaccgttttgaccgggcccactctcggccaccgcgtgcgtcctctcagtaaggacgccgagctgactgcccggcgctggctcgaccaggtcgccgacaaccccggcttcctcgacacccttatcgaggccgcccgcatcaccgatggatggcatcacgcgacgcctccgcacattcaggccccttaccggacccttcatcagtgaacggaggtacaacgacatgaccagcgacattgacattgaccggacccacaaacccgacgaccgcgccgaggctcctctttaccggtcctgggccaggagactcgtgcacgtctccgggatgccctggcgtatcgtcgccgccttggccggggtctcccccacctccatgcaccggcttctattcggccgcaacggtcgacccgtggaatggatcggcatcaatgatgctcgcgccctgatggatatcggcatcgatgatctcgcctcagcgtccaccgaccgtatcccggcccgcgaatcccgcgagctgttggtagccctgcacaccctcggctggaccgatgagcatctaagccgctggctgaccagtcccgacctcgacctggccaccacccccaaggccctctacgtcacccggctatccgccgcccgcatccaggccacctacgacatgctcatcagccagcccgtccgccgctgcggcc

SEQ ID NO: 320 - DNA, 2014 bp, Propionibacterium acnes
ccggagtatctggacaaggccgtgctcactgcgttgtatcccgatgggttgcccttcgacgaggacaccgaggagccgggcgagaatgccgggcaggaggagcttgcgatgactggatgagcccgaacatggttgaaggccgccccgccaggcgaccttcaatcaatggtttcggttgtcagctgcagccacccttgccaggtgctgtggttcttctccagaggaggagggaccgccatgaagacccagaagatctagaagatccaaaagaaccggtttcggctgttgcttcggtcttcatggtagctgatagcccgcgtcgttggaagtgcgacgacgccgatcctcatcggtatcgcaccctgttccagggtcgagaatgtgaaggattaacaaccatgacaagtcatgagacgccctccctgagggcgtcatgaccgctttaattcaagctctgccgacagctgaactgtctgctggacctggtgctagcagtccagctagaccctctgctgagggcttcatcaagattcatcacgaccttattagtgcgggcgtgtcgggtaacgcgatggcgttgttcgtcgcgttacgtaaccagcccggctgtgatcagtggacccgtcactcgtacctgcggctagcccaatggtgcggctgggatgggctgtcggaggcggcgggctgtaagcgggtgcagcgggccgctgctgagctcgctagcggtggttggctggaatcgcgggtcggccatgatcgtcgcaccgctaagacgctggtgtggcatcggttgaccagccccgacaccgaccgctgggagcaattgccgcggattgtgtgggcgaggatctgccagatcgccggggagacgtcgggagagtgggtgaggcattggctggtgtggcggatgctggccggtcgtactggtgtggctcaggcccctacgtccatcgtggctcggttcctgggctgttcttcgcgccaggtctctcatatccgtggggctctcgttgatgccggtctgctcggctgtgacgaggtctcgggggcggcgagccgggtgtggttcccctcgatggccgaggagtgtgcagcggatcgtgaggtggtcgatggggccgtcgtcgatgctgaggtgggctctggtgaaggtgtcgaggagggcggggaacccctgtcgattttgtccacccacccctgtcgattttgtccacccacccctgtcgattttgtccgccaagtattagacaaaccattagacagtgaattagaccctgggtcgcgtcagcgtgttagctcaccaacgcgcgcgcgtgcggcggccgagccgccgaagccaaagaaacccacaccaccaacgcctgaaccagcagcccccgcttcagacagtcctgtgtcagcgcacgctgatgaggctgccgagttggcgtggcagttcgtggggtggtgtcctcagctggtaggggcaccgaagaaggtgcgtggccagctccgtcagctggtcgctgccgagatccgccggaatccgggctggctggatgcgccagcgttggaggttgttgcccagcgggtacgtgctgaaggtgcgctgggggtccagcactgcgagattgtgcgagccgagctgcacggggtgatcgccgaccagaaggccgcccccgcccgccccgacgccctgcacgcgcgggagcccaagtggtgggacgacgtgtactacgaaggaaacacaaccgtgtggacgtacgactctgacgaaaccagtgacgacgacgaggcgtggaaccggtcgcaggtatgtcatgttgctgagcgtgacgacatggctggcgggattgctaccaacctgctggcctcccacgctgatgatccgatggcctggctgactcgccgtcaaaccatgctgatggctcgtttcccccacgcccagaacgaggtcaccgcgatgtgccaaatcgtgcgcaccgccctggaggccgacctggccgccggaacccggtgggaggaccgatgaggg

SEQ ID NO: 321 - DNA, 1950 bp, Propionibacterium acnes
tcggtgtccccggccatgcgggccgcactgcgactccaaggcacgacccccgaagcgttctacggtcgacgcctgatctgcgcactgatcggggcgatcctgccgtggctgctcaacgcggtagccatcgcggtaggggcgaattccccgaacctactcatcccttcggcgctgtgtgtggcgttagctggcgctggatggatgctgccggcagcacggttgaaggctgcggccgggcccaccaacgatgactcgttcgaagcgctgctggtattcatcgatttggtcgtgctggaacggctcgccaacgaaacctccgtcgacgcgctcaccaatgcggcaaacatgtcggactcgccgctattcgtccagatccgtcaagtcctcaaccgtgcctccctggaaaacgtcgacccgtggaacgggctagaccggctagccgaggacatcaaactgcccgaactcaccgatgtggtctccatcgcccgcctccaaaacgaaggcgcctccctcgtcgacagtttccgggcccgagtcgccgagttacgcgacgcctacctgctgcgcctgcaacaagaatccaccgccatcacccagcggcttggtttgtggacgatcctgcaagccggctcggtcatgctcatcttgctgggggcggccgccctcacactcatcacagccggataaaccgacaccgtgtcgagcccccatatgggccgcgaacctttcataatgatgcctgtaagcaccacaatattgatcacaacctaacaatgaaggagaaatcatgatgaccgatctcgacctggctaaaaaacagatcacctggctggcggcgcacctgcgttcccggatcgttgacgagcgtggcggtggtagctctaccgtggagacactgatttggattggtgtcatcgtggcgctggtgattggtgtgggcgtcggggtgacggcctatatcaggtcgaagatgcctcactgacgacgatgcgtagcaggttcacaactgatcagcgtggcggtggtagcgcgtcggtggggatgctcctgctgatgcctgcgatcatgctgctggcattcggtgggatcgaggtcgggatgtggtgtcacgcccatcagtcgaccatcgcggcagcccaaagcgccgcggaagctcagcgtgtcgtccatccggtcccggggtcggcacaggaggcagcctcgcagatcactagtcatggcggggtgcgtgatacccggatatcggtcagtgatgacggggccactgtcacggtgaccgtggtgggccgggccccatcgatgctggggctgcatcttcctgctgtgtcgtcgacagcgtcgatgcccaaggagcgcctgtcgtgaggcgaagtgagcgcggcggagcaagtctaagcgtcgaggtgctcatgtgggcgccgatcgcgctggtgatcatcgggtttgttgtgggtatcggccggatgtcgatggcccaggacgcggtgagtggcgcggcgggtgctgcggcccgtgcggcgtcgttggagcgtgatggacagtcggctcagtctgcggcgcagcaggcggcgtcggcgaacctgtcgtccggtgggctggcatgtgcgccgagtgtgagcgtggacacgtcagtgtttgcccgtcctgccgggcaggcgggcacggttcacgccacggtcacgtgtgtcacctcgctgggtcttggattcgggtcccggacggtgcacgcaacggggtctgccccggtagacacctatcgggaaaggagaggctgagatggcccgcgatgagcgtggtggcggctcggtgtcggtgtggatgctgctcatggtgccggtgattctggtcatggccggcctggtttttgacgggtcccgtcagatatcggcaacccaggcggcccaggacgcggcggttgcggcatcccgcgccggaactgatgcggcagcg

SEQ ID NO: 322 - DNA, 2060 bp, Propionibacterium acnes
gcgagccacgaccatcgccaagctgaatggagagcgagcatgagcaccacccctgccgggttcgacttcgacgctctggccgagtgggccgagagcgatgaggcgacccacaccccgcaaaccagccccgtgttccggggcaaggacgccgcgcgcgccagccgcgcattcctcggccgaggacggcccaccctcggcgcggaccacgccaccggcgagggccggtcgccccgccgtcaggtacggctcgacgcacgcaccaacgcgcgactcgacgcctacgcagccgcaaccggcaccagcgcctcccagatcatccgcgacgccctcgctgactacctgcccgcctgatcccaccccaatccactcgggcgcctgtcagtgccccctcttctgggtggtggtccggggcgtcaccgccccggaccagttggggagtcatctcagttgaaataagcgattagtgatacgcccctcctgctttccggtgctgtcatgagcgtctgacaacagcgacacctcggggcagccgacggacagtcctctggctgccgctctgatcccatgcccacggcacgaaggtgtcggacagctcggtctcatcatgtgcccaaatagcgtcgtgggcctgtcgccaagcttctcgggagccccacacgggcacgaccgggccacaccggtgtcctggtctccagtgtcgcgacactgtcgatttcggtacgtgcaatgcggcggcggtttgacggatcgacatcccagactcccgcgcgtcccagatcgccatgtggagagtatttgcctccagtgcggccgccacacttgcacgctctcgcgcacgctcgaatgcccgcctagtgctctcaaatgtcgtcacgacgcctccccctgaaaatactcagggtgtcccacggtgggacaccctgagtatttcataccccaactcgcctcaccacacgtcgacctcgacaccgatcaagcgacccgtatcagcgacattgccgtaccgctgccccgcctggtcctccagccacgacaacgcatcccgaaacagcccgacgtcttccaaagctaaaccacagtcgtagccgcccttgtcccccaaccgcaccatctggcgctcccggtggcctccctcgtcgacctcgatccacagtttcgcgtgcatccgctggcctcggccctctgacaggatctcggtgagcaggtcggacgcctgccctcgcgcatcctcgttactgcgggggaattggagtatgtgggaggaacgatgatgggggaggttggtgacctcatggcgcagcaggttgcgcttgtgcatcttccgctcaaggcgctcgggctgacctgttgacggggttgagccgtggcgccgcttcctcggcggggtctcgatccgttgctcttccggcggttcggcgtcaggttgtggtgcgcgatctcccctaggacgggggggatcgccacctatatccgagggacgatgagacggccttccacgcttgctgcgcactttcgcagcccgccccttgcggtcacgtcgacgcggcggcggagtgacgtcctcaccgcgcgctaactgcgtcaacgccgccaccaggttggtgcccggtttcagccctttcagcacgaaccgcaccaggcgggggtctcggccgattcgtcgggcaatctcggcttggctccacccctcggccaacagggtgcgcaacaagtcttgggcccggttatcacgctcagtcactggtcgccccctcggggagtcctacttgctcggcctgctctgatagagcagcccgctccgatccggtctgaggcgcttccaaagggcccggcaagacacctttgacacgcagccgcccgtccttgccgtcatcgccgcccccctgggccacagggagcgcccaggggggcacgttgctggtgtagatggcgtcgccgtggatagccagcacggtgcgggagttcatgcgtagtgctcctcccttggttgtggcgttttttccggtggtggggtcggcgatgggtgtgttgagggtgcgcacgcgggacaaggcccagat

SEQ ID NO: 323 - DNA, 1856 bp, Propionibacterium acnes
ttggtattggtaggcgatggtgtcaccggttttgttgcggatgacgtcgaagccttcgatgtcggaggggatgtcgtcggcgtcgtagacgacggtggtggtgacggggttggaggccgacatttggccgatggtcacgcgcagcatgtttttcaacgcggaggtgaggattgtcgtggcggtggggtttttgtctgcccagcgtttctcggcgatgtcgatcatgtcttggatggttttgacccatcctcggatgggatcgactttggtcagtttgatcccttcgaggaactcgatgggctgggtgatgggcccatctggtccggcttcggtgtcccagccttcgtcgatggctagtttcagttcggcggtatcgacccatgtttcgtgggtggtgccgggcacgttgggccaaaaccatcctgctcgtcctttggtgcgtttgaccggtagtaggccgatgtcgtcccaccaggatggcacggtgaagcggatgtggtagcgggccgggtgccaggggttgttggtgaacaggtcgcgggcttcggtggcgctgagcagagtggcgggtgcggcaccgatctctccggtcactgatccggcatacatgaatcggccgtcgatgtacacgaagttagggatagggccggcaggcacggtggggcgccagcccttttcgcggtcctcggggttgccgtcgtcgacgcatagttcgtagcggtgctgaggggaggtgtgttggatgagtgcgcccagttcggggtccatcggctccatgcgataggactcgggggtccgtagcttccagaggttgattccttctgctccggggcggtccatgagggcccagtcgcggtcgattctggtggcgatgatgtgggttaattcgcgccatgcccagcgggcctggattggggtgagggtctggccagggaaccattcatcagcgaccagaatgtcgaggttgcggtcggtttctttgtgggtgaaccggcctcgggcgggccgcccggacagcatgaacaggccccgcacgtgccagtcctggttgaactcgcgggtgtgagcgggggtgtcaggcagcagccaggattgaggctggtcggggatgttaccgcagacgatcaggcgtcgggcgttgtggtgtagcgcggttgttagcaggtctgacagggtcgcgtgcttggtgcgtcgtccccccagcactggcaggatctcgtttccggccgcgtcgactccccgggcggtgtcgatgtctagccacactgtttcggggtcggggggccgatgtggggcgggacggcgctgctcctggtcgtctctcatggtttcctcctttgggccagggagcggccggcgtcgagggcgttcatgcgctcgcgttgttcttcgcgtagttggtagacccggcctcgtgacactcctgctgcctcggcgatggtggtggccggcaggtggccgatggcggcagcgtcggcaaggacgtcacgccaggccaggtcaatggttcccagctgggctagagcttcgtcgcggcggcgggtggcatcagccactacggaggcccaccctgtggggtggatggtcttgacgacgattcggttgtggcggatggggccccatgcatcagcggggacttgccagccgtgattggcggcggactcggtgatcttgaggcgtcgctcaggtgcgcgggtgcgggcagtgacgtcggtgttccaggtctggactggtacccacgtcccctctcggatgcgttcgatgacgcacgtggtgacctcgtcggtgactgtgatgaccagacgataatctttcccgtctggagtggttcgatagctgggcatgtcaccctcccc

SEQ ID NO: 324 - DNA, 1832 bp, Propionibacterium acnes
ttggtattggtaggcgatggtgtcaccggttttgttgcggatgacgtcgaagccttcgatgtcggaggggatgtcgtcggcgtcgtagacgacggtggtggtgacggggttggaggccgacatttggccgatggtcacgcgcagcatgtttttcaacgcggaggtgaggattgtcgtggcggtggggtttttgtctgcccagcgtttctcggcgatgtcgatcatgtcttggatggttttgacccatcctcggatgggatcgactttggtcagtttgatcccttcgaggaactcgatgggctgggtgatgggcccatctggtccggcttcggtgtcccagccttcgtcgatggctagtttcagttcggcggtatcgacccatgtttcgtgggtggtgccgggcacgttgggccaaaaccatcctgctcgtcctttggtgcgtttgaccggtagtaggccgatgtcgtcccaccaggatggcacggtgaagcggatgtggtagcgggccgggtgccaggggttgttggtgaacaggtcgcgggcttcggtggcgctgagcagagtggcgggtgcggcaccgatctctccggtcactgatccggcatacatgaatcggccgtcgatgtacacgaagttagggatagggccggcaggcacggtggggcgccagcccttttcgcggtcctcggggttgccgtcgtcgacgcatagttcgtagcggtgctgaggggaggtgtgttggatgagtgcgcccagttcggggtccatcggctccatgcgataggactcgggggtccgtagcttccagaggttgattccttctgctccggggcggtccatgagggcccagtcgcggtcgattctggtggcgatgatgtgggttaattcgcgccatgcccagcgggcctggattggggtgagggtctggccagggaaccattcatcagcgaccagaatgtcgaggttgcggtcggtttctttgtgggtgaaccggcctcgggcgggccgcccggacagcatgaacaggccccgcacgtgccagtcctggttgaactcgcgggtgtgagcgggggtgtcaggcagcagccaggattgaggctggtcggggatgttaccgcagacgatcaggcgtcgggcgttgtggtgtagcgcggttgttagcaggtctgacagggtcgcgtgcttggtgcgtcgtccccccagcactggcaggatctcgtttccggccgcgtcgactccccgggcggtgtcgatgtctagccacactgtttcggggtcggggggccgatgtggggcgggacggcgctgctcctggtcgtctctcatggtttcctcctttgggccagggagcggccggcgtcgagggcgttcatgcgctcgcgttgttcttcgcgtagttggtagacccggcctcgtgacactcctgctgcctcggcgatggtggtggccggcaggtggccgatggcggcagcgtcggcaaggacgtcacgccaggccaggtcaatggttcccagctgggctagagcttcgtcgcggcggcgggtggcatcagccactacggaggcccaccctgtggggtggatggtcttgacgacgattcggttgtggcggatggggccccatgcatcagcggggacttgccagccgtgattggcggcggactcggtgatcttgaggcgtcgctcaggtgcgcgggtgcgggcagtgacgtcggtgttccaggtctggactggtacccacgtcccctctcggatgcgttcgatgacgcacgtggtgacctcgtcggtgactgtgatgaccagacgataatctttcccgtctggggtggttcg

SEQ ID NO: 325 - DNA, 1890 bp, Propionibacterium acnes
ccacccctgccgggttcgacttcgacgctctggccgagtgggccgagagcgatgaggcgacccacaccccgcaaaccagccccgtgttccggggcaaggacgccgcgcgcgccagccgcgcattcctcggccgaggacggcccaccctcggcgcggaccacgccaccggcgagggccggtcgccccgccgtcaggtacggctcgacgcacgcaccaacgcgcgactcgacgcctacgcagccgcaaccggcaccagcgcctcccagatcatccgcgacgccctcgctgactacctgcccgcctgatcccaccccaatccactcgggcgcctgtcagtgccccctcttctgggtggtggtccggggcgtcaccgccccggaccagttgggtagtcatctcagttgaaataagcgattagtgatacgcccctcctgctttccggtgctgtcatgagcgtctgacaacagcgacacctcggggcagccgacggacagtcctctggctgccgctctgatcccatgcccacggcacgaaggtgtcggacagctcggtctcatcatgtgcccaaatagcgtcgtgggcctgtcgccaagcttctcgggagccccacacgggcacgaccgggccacaccggtgtcctggtctccagtgtcgcgacactgtcgatttcggtacgtgcaatgcggcggcggtttgacggatcgacatcccagactcccgcgcgtcccagatcgccatgtggagagtatttgcctccagtgcggccgccacacttgcacgctctcgcgcacgctcgaatgcccgcctagtgctctcaaatgtcgtcacgacgcctccccctgaaaatactcagggtgtcccacggtgggacaccctgagtatttcataccccaactcgcctcaccacacgtcgacctcgacaccgatcaagcgacccgtatcagcgacattgccgtaccgctgccccgcctggtcctccagccacgacaacgcatcccgaaacagcccgacgtcttccaaagctaaaccacagtcgtagccgcccttgtcccccaaccgcaccatctggcgctcccggtggcctccctcgtcgacctcgatccacagtttcgcgtgcatccgctggcctcggccctctgacaggatctcggtgagcaggtcggacgcctgccctcgcgcatcctcgttactgcgggggaattggagtatgtgggaggaacgatgatgggggaggttggtgacctcatggcgcagcaggttgcgcttgtgcatcttccgctcaaggcgctcgggctgacctgttgacggggttgagccgtggcgccgcttcctcggcggggtctcgatccgttgctcttccggcggttcggcgtcaggttgtggtgcgcgatctcccctaggacgggggggatcgccacctatatccgagggacgatgagacggccttccacgcttgctgcgcactttcgcagcccgccccttgcggtcacgtcgacgcggcggcggagtgacgtcctcaccgcgcgctaactgcgtcaacgccgccaccaggttggtgcccggtttcagccctttcagcacgaaccgcaccaggcgggggtctcggccgattcgtcgggcaatctcggcttggctccacccctcggccaacagggtgcgcaacaagtcttgggcccggttatcacgctcagtcactggtcgccccctcggggagtcctacttgctcggcctgctctgatagagcagcccgctccgatccggtctgaggcgcttccaaagggcccggcaagacacctttgacacgcagccgcccgtccttgccgtcatcgccgcccccctgggccacagggagcgcccaggggggcacgttgctggtgtagatggcgtcgc

SEQ ID NO: 326 - DNA, 1795 bp, Propionibacterium acnes
gacgccggccaccccaactactccgacccacacggtgaccccagctccggcctctgccggccactcgaccagcgacgagcacccaatccatacggataccgccacagcggacaaggccagcgacgaggacgccctgtccccaatccaggtgggcttgaccgccagcgtcggactggtgctggtcgccggactgatcaccaccctcaaccgccgctaccggacccggttcacccgccagccccgcggcaaggccatgaccctgcccagcccggacgcccaaactgccgagatagcgctgcgcagcaccggggcgactgacactctgacgatcacctgcctcgaccaggcgctccgcgcgatcggcgcatggtgccaccactgcgggcacccgctgccacccctgctggccgcccgcgtcgatgacgaccggatcgacctgctgctatcccaggcggcccccgaccatcccgaggcggtggagctggccgccgacggatcggtgtggaccctcaccgccgaccggatcgacgacctgctagcccacaccgatgacaaccaagcggctccgtggccgtctctggtcacactgggacgcgacgacgacgacgcccacatcctcatcgacttggaagccgcaggaaccttgcacctgatcgccgatgacgaccaggtcgacgcggccctcgccgcgatcgccgtggaactggccacctgtgactggtccgacgaggtcaacgtcaccctggtcggccaggtgtgcccgggcctagaagacgcactagagtctccgaccctgacccgcgccaccgacgtggacgccctcctcacccccctggaagctcgcgccgacgaccagcgacacatcctcaccgaaggaagccccctcgccgctcaccgagccgaccccgccatctccgacgggttcgacgccgaagtgatcctcctcgacaccgaactcaccgaagaccaccgcaaccgcctcgccagcctcgtcgaggctcttccccgcgtgtcagtcgccgcggtaacaaccagccccaccagcccagacgaatggtccctcaccctgacaggtgacccactagccgccgacgtggctcccctcggctggcacatccacccccaaaccctctcccccgacctgtacaaccgcatggttgaactactcgccaactccgccgccgcagactacgaacccgccagctggtggaaccacgacgccgacgacgagcccaccaccgaccccaccaacgaggaagaatctaccccgagcaggcgagcccgcccgaatatccgcctgaccaccctgaccggcggcatcgacctatccagcgtcgacatcgacgacatcatcgacgaagccaaccaggccctcgacaacaccgaccaggccaccaaccaggttcgtgtcgacaccgaccaacccggcaccgacacccccttccccatcgacgacatcgacccgctgagctccgaccatccggtcctatccatcatcggccaccccgacatcacaggtgccactggaaccgttgggcgctccccgtggcgctgccaacagttggccctctacatcgctgagcatccgggggtatcgggggcgactatcgccgatgatttggggctatcagcgtcgacggtgcgctcgattgctacacacctgcgacactggttgggagccgacgatgccggggtggcttacatgccggcggcgacgcgcggctaccggctcgatgagcggatcgtcacagatgtggacctgatcgacgctgctgtggccggggcaggcattaac

SEQ ID NO: 327 - DNA, 850 bp, Propionibacterium acnes
gacagtgatacgtcgtatcggtgccctggtggcactgctggtggtgatagccggcttacccgccgggctcgtggccgcaggcgccccgctagtaccctcgggcctgtcatgggcccatgtgcggcatctgttggttaccccagacatgaccgggtcggtgctggtgtggctggtcagcctcatcggctggatcgggtgggcatggttcgccctggccgtcgcagccgaagcggtgacgatgctctcagggcagcggctgcactggcacatgcccggccctcgcctagtgcgccgagtggcagccggtctcctcattgccgcgttcgcggccgcaccggcagccacaagcacggctcacgccgccgaggccacccatgtggcggtcgccgcccaggctggaccggcacacgcggccggcacccaggacagccccgccaccacctctcaggccccggacgcctccaccactccgaaaatctggaagacctacacggtgcgggccaacgactacctgtggaagatcgccgagcactactacggtgacggcgcccaattccgtcgtatcgccgaagcctccggtatcgacccgcactcagagctgaaagccggccagaaactgatcctgccggttcctaagaacacggccgcagtccactcggttaaagcgggggagtatctgtggaagatcgccgagcactactacggtgacggcgcccagtaccataaaatcgctgaagcttccggtatcgatgcccattccgatctagccgtgggccaaaaactcgtcatccccgggcccctccgccacgacgccacgccgccacaccactcggcgtcgacccacgcgaag

SEQ ID NO: 328 - DNA, 1845 bp, Propionibacterium acnes
attcttgtttggcggtcatgatagcgatgaccgctgcctgggtaggcagtttgtcacgctggaccacagtgacgatggtggtcacgagctgcttctgtctggcggtgaggcctccggcgccgaccccgccgccggtgacagttcccatgcaggcatccccgccagcgcctccaccagagttatcgtcgagggccccagagcctactgacagcagcggcacaatgatcacggtcgctggcaagaccgccaggcccgccagcatcagcactgctgcactcaccacggcgatcacgtgagatgctttcaacgctgcccacctctcgctggtttgagggggcgacgcctgctggtacgcacaggcttggttgatccagtccgccgttgattggcaggcctgggtttgatcggcttgctgggacccggtttgggctccggagtcttaggctccggcttcacatgcctaggcacttcggctgcggtgggaggagtcagcacgtggcgtaccggcttggtgaccttctgggcacccgaaacaaccggcttagacaccaccttggcacctttgaccaccggtgcggctgccttcgcgccggccttcttgactgcacgatgcgctttgatagccccggcctcggcccggccaaccctactagcagtagcatcgagggctctgtggcccgtcgttgccctcaccggtgcatccttgccctggcgggtctgcttagcgatcgccgacataccgccccgcaatgccgaaacatgattgtgggcgtgggcgatcgccgacatgccggccgtcgcgatttttgactggccctgcggggcccctgccccagcacgaatctgccggtaagccgccgacgtgccacgagcacccgccgccattcgcgccaccttcgcagccctagtcactcccgtcgacacgccacccgtggctaccgcagcagcacccgagaccacagtcgaggccatccgccttcgacccaatccggtgagcttgcgaccaccgctgcgcaccatccggcgagcaccccgcccagcccactggccgatcaccgagcccctttcggaacgcttgctgcgcatccaatcgttgatcttgtccctcagccccttctcgcccttgtgacgacgccacatggacatcaagaacccgataatccccacgagctcgagcatgttgacaaccatgaccttgatggcgacatcaccgtcagaggcgaaaaccgacttgatgatgagcatgaccacacccaacatcaccatcgacccgacaatgccgatcatcgagtacaagatcgaacacagatcccggatgagcggatctgtgcggccagggatagcccgcaacacgttgagcatcgacatgaacgccgaccacaccaacttgcacacgtagaaccagcacatgcccgcgaacaccagcaggaccacagccaaacccgccaccgttgacgagtaaaagaagaaccccaccaaccacgaaccatccgcaatatcgccggcgtaatccgacaacccctcatcacagtcaccaaggtcgtcgcgagcatccgagacgtcatcgtaagggccacccttgagcacctcgatgtacttgtcgtggcacttcgcatcaataatgcggccatagttgagctgctgatgaaccggcgccacgaacgagtccacaatgatcgccgacagcttcggatccttcgagtctcccgtcgaggtcatgtcatcaggaatctcgacctcaccagcggtcgccgtcgcaggatcaaccgaactggtaatcatatgagacagcgccacaccgaactgctgggtgcgagccagcggagtagccaacgtcgtcgtatc

SEQ ID NO: 329 - DNA, 1875 bp, Propionibacterium acnes
ttgatgagcaccccagcggccagctctgtggcagcaaccgggtgggctgggctgtagaggaggtcgatgtcgcgggcagggtcgtcgggttcttcggttacctcgggtggggtcgatctggctgtctcggtgtcgtcggccaggtcggctcccaggatgcgttcccattcggggctggttttcttgcccgctgaggccatcgtctcgtcgatctgttcgtcagtgggccacacaaatttctttttggtccaggtcgtggtgtcgggtcgcagctgatccagcagttccaggtcttgcggggagtgggccttgcgggggtcgggggtgtagaagaattggacttccttgggggctgattcgccggataggtaggtgccgcggccgcgtttgccgaacgggattcccacgccgacgtgttcggagccgaacatcatgcgggctccgtcagcggacaggggtccggtggcggcacgcccggagaagttgtctcggatttcgccgcccaggaactcggcgtcggggcgttgggtccccagatcgacgtggatacggcaggcggctgccatgcgcagcagggagccgatccagccgaaaacggggcattctccgggcatcccagagaccttgatcgttgaccaccagtttttcgcgttgccgtagaactggcggtactcgtcgatgaggaccagcacgcgggtgaagtcggtctcgcgggccccttcttcttcgatgcggcggtagcggtcctccatgagagaccacagccagtggatgagggcgacctggtcggggacggtagtggcgaccatctcgatgttgggccactcccgcaggcccaggtactcgatgcgtttagggtcgatgacgaagacgcgccagttgcggcgggcaccctcgacggcgtcgccgatcatggacaccgtttttccggtacgggtgcggccggccttgagctggtgggccatgacaccggagatgtcccagaaacaggtgttgccgtcctcgtcgacggcctgggggattttctcccagtctggggagtctgggcccggaagggccacgggtcggggcaccatcgagggcagggggtggcggcgggtgacggtgatggtgtcgtgttccaggtcgaagtcgctgcgccactggccgagcatcatcgccgaggtcaccgcggccaggcgcaattggatgttcgggctggacaaatgggcgccacgttggtggtgaatggtgaagccgtccaggttcccccgatcggttttccaggaatcgacggtgaccgccgacccatagatctgagtggctacttctttagcccgttccttgtctcggtccagatcggttttgtcagggtcaggggtcggggcgcggtattgcaggacgaaccggccggccgggatcgttgcggatgtcaccgtgaactctgccggcgaccaggcagccgcggccgcctgggtgagggccattggcatggtctcgacggcagcctcctcgggggggatggtgagggtcaggcgtcgcggatgcgtcttcttgcgattccatgtgactttctgcctcaccggcaccttcgccgccgactgaatggctaggcgagctgattcggcagtttcggtacgccggccagcgcgtagcgcccgtcgtgcgtgaaggctgcccaccacagcacagcccatacacggcagccaccagcgcggatcagcggctgctgcatagcccccggtagctagtaccgcacctgaccagccggccgcgatacttttccacgccggtttcgcaccaacagtcggggcagacgctggccgcttcgagaccgaggagggacgagacaagggagtgctggtcatgccgcggcctccttgtggcaggtcattt

SEQ ID NO: 330 - DNA, 1794 bp, Propionibacterium acnes
agaagacgcactagagtctccgaccctgacccgcgccaccgacgtggacaccctcctcaccaccctagaagctcgcgccgacgaccagcgacacatcctcaccgaaggaaaccccctcgccgctcaccgagccgaccccgccatctccgacgggttcgacgccgaagtgatcctcctcgacaccgaactcaccgaagaccaccgcaaccgcctcgccagcctcgtcgaggctcttccccgcgtgtcagtcgccgcggtaacaaccagccccaccagctcagacgaatggtccctcaccctgacaggtgacccactagccgccgacctggctcccctcggctggcacatccacccccaaaccctctcccccgacctgtacaaccgcatggttgaactactcgccaactccgccgccgcagactacgaacccgccagctggtggaaccacgacgccgacgacgagcccaccaccgaccccaccaacgaggaagaatctaccccgagcaggcgagcccgcccgaatatccgcctgaccaccctgaccggcggcatcgacctatccagcgtcgacatcgacgacatcatcgacgaagccaaccaggccctcgacaacaccgaccagaccaccaaccaggttcgcgtcgacaccaaccaacccggcaccgacacccccttccccatcgacgacatcgacccgctgagctccgaccatccggtcctatccatcatcggccaccccgacatcacaggtgccactggaaccgttgggcgctccccgtggcgctgccaacagttggctctctacatcgctgagcatccgggagcatcgggggcgactatcgccgatgatttggggctatcagcgtcgacggtgcgctcgattgctacacacctgcgacactggttgggagccgacgatgccggggtggcttacatgccggcggcgacgcgcggctaccggctcgatgagcggatcgtcacagatgtggacctgatcgacgctgctgtggccggggcaggcattaacaccgctgagacggccacactggtggccattttgaagctgggccgcggacgggtcttcgctggggttcctgactcggaacttcgccagttcagggcgtcgatgtaccacgtggaggcccgcatcgtcgatgctgccctccaagtgacagaccgggccctggaagccggggacctggggctggcccggtgggcgttgacccaagggctactggtgtctcccgatcatgaggacctggtcaccggttgtctgcgcaccgagtaccaggccggcaacatggacaaggtttccgagctggtcgatcacctgtcggctaccgcacgacgcctgggcgtcgatttgagcgccgacaccacccggatcatcgactccgttattacccatacacgcaggagagcatcatgatctcccgttgcactcatctccgtcaggaaggttcctatgcaccattatcgtcttggtatcggcactgccctcatcgcggtagcagccgtggccggctgtcgctcaacagactcgacacccacaccacctccatcccgtgtctccgccacgacatcagcgagctctaccctcagcccgaccccgtcagccggagcggtcagtgccgccgacgccgaaaaggtctaccgcaccttgcacaccaacgtgttcgcattggagaagaagggtggcctggtacccggggaacccgcacccgcatccctctcggactacgccagcggccaagcactcaagaactacatgaccttcaaccaccaaatctcggg

SEQ ID NO: 331 - DNA, 1064 bp, Propionibacterium acnes
caccaacacatccaaaaccatcctcacgctcacccgcacagccaccatctcccacctgctagccatcctcgatggcctaccccaagctgaggggactcactggctcaacactcaacccgacctccaccacatcaccctcgacgactccaccaccggctgggccaccaaccgcaccgacgacaccgacaccggcgtctgctacgacaccagcacccacaactggcagatctgctgacagcatgacgggcctgcccttgaggggttggactctgcacccatttcagccgggtacgttgccggctgggcgaaggaagcagacggcgccgcgattgaagctgccgccgagcacgtcgcgaagacctcccacgcgattgccgaggcgttgcagctcaccgcacagtgagccccacggggcgaccggctcaccccggtcgcccctcaccccccgacaggggaaccgttcccgccgcctgaatctccatacccctgatacgtactacgcggggtcgaggagtggactcccccgccctgagcagtacactgtactacacagtcattgaggatagaggtgacgtcatgagtttttcgatccgtttacccgaccatgagcgccgcttagcggactcctacgcccgcctacactcacaatccctgagcgaggctttcaagcaagccctcttcgaccgcatcgccgacgagttcgaccttcagatagcacacgaagctctcaccgactacgccaacgacaactaccagtctcgtcccatcagcgagctatgggacgagtgtgacctatgagctggcagatcgaaaccactagccggttcgataaagaattcaaaaagctggaccgctacacccaaaaactcattcacggctggatcacgaaaaacatcgacaacaccgacgatccccgccgccacggcaagcccctcaccggtgatctttctggactgtggcgctaccggatcggtgattatcgcctcatatgcacactcaacgatgaccgcctcatcatccttgccctgtccatcggtcaccgccgcgacatctaccgctaagcc

SEQ ID NO: 332 - DNA, 1639 bp, Propionibacterium acnes
gagccagttatcctcatctacgacgatggctatgaactcctgatccacgccatgaaagcccgccctcagtatctgagctacttcgctatctagtgttgttgggcgagttgaactcaacttttctccgacgcaagcgccaataaaaggctgatccatccgaataccaccaaacacggctgaagtgtggaacagattcagcaagacagggtgcggtgctcgggtgcgttggggagatgaggatattcaggcttctggcgggatgtggcttgatgacgtccaggatcaccggttcggttttgaaggtgccttgcattaatgtcgacagggtcgtacgactcgaggactggatcgaccagcccgttgcgtctgaagaacttcatccaccccggtggagctccggccgcgtactggtgcaacggatcattagcatgggtagcgtgagtatgccttcgatcgtggtcagtgctgtcatcatccaagattctgacgggcggcttctcactgtccgtaaacgaggcgccgaggcattcatgctgccaggcggcaagccggagcccggcgaggactcgcgtcaggcagtagtccgggaagtgcacgaagagctcggcgtcgcattgtcttccgacgacctgcgtcgggtgggagtgttcaccacgcgagcagcgaatgaggccggccatcaggtggtggcgacgattttcacccacaccccggttgcggtgagtgagccagctgctgagatcgagcagattcgttggctcgattggagtgtcgacgccctgcctgatgacctggccccgctgctggtcgaggcagtcatcccgtggctgcggcgccgtatccggtcggtcgctgtattcacgggtgcgaaggatggaaccgaccctcattatcgtgtcgaagcaaccgccttgggccggggtctcgcacacgccgggatcaccctggtttatggcggcgggaaggtcgggatgatgggtgctgttgctgatgcggccctcgctgctggcggcgctgtgatcggagtgatgccgcagcacttggtggacggggagatcgcccatcctagtctgactcacctcgaggtagtgcggactatgcatgagcgcaagcagcggatgagtgacctagctgacgcgttcgtcgcgctacccggcggcggcggaacccttgacgagctattcgaagcatggacatggcagcagctcggtgtacacagcaaacccgtggccttgtacgactcgaccttctgggcaccgctgaccgcgctactcaaccacatgaccatcgaaggcttcatccgccctgaggaccgcgcctcgctcgtgatcgccgataccatacatcagctgatggccgatcttgagggatggaccccaccaccaccgaagtggcgctcgtgacatagaacaaatgattctgactatggctcattgacatctgcgcagcggctactagctccatcgacttcaaatcgggccttggccgaggctcggttcaggtggcccggaatggatccccacaaattgaatgctcatgatcgaggtgatgaacgcccactctattgtcctacgcccggttgtatccagcgagcaattgaaggtgctgcgcctgttggtcgaccaggccgagccactca

SEQ ID NO: 333 - DNA, 1200 bp, Propionibacterium acnes
ccggagtatctggacaaggccgtgctcactgcgttgtatcccgatgggttgcccttcgacgaggacaccgaggagccgggcgagaatgccgggcaggaggagcttgcgatgactggatgagcccgaacatggttgaaggccgccccgccaggcgaccttcaatcaatggtttcggttgtcagctgcagccacccttgccaggtgctgtggttcttctccagaggaggagggaccgccatgaagacccagaagatctagaagatccaaaagaaccggtttcggctgttgcttcggtcttcatggtagctgatagcccgcgtcgttggaagtgcgacgacgccgatcctcatcggtatcgcaccctgttccagggtcgagaatgtgaaggattaacaaccatgacaagtcatgagacgccctccctgagggcgtcatgaccgctttaattcaagctctgccgacagctgaactgtctgctggacctggtgctagcagtccagctagaccctctgctgagggcttcatcaagattcatcacgaccttattagtgcgggcgtgtcgggtaacgcgatggcgttgttcgtcgcgttacgtaaccagcccggctgtgatcagtggacccgtcactcgtacctgcggctagcccaatggtgcggctgggatgggctgtcggaggcggcgggctgtaagcgggtgcagcgggccgctgctgagctcgctagcggtggttggctggaatcgcgggtcggccatgatcgtcgcaccgctaagacgctggtgtggcatcggttgaccagccccgacaccgaccgctgggagcaattgccgcggattgtgtgggcgaggatctgccagatcgccggggagacgtcgggagagtgggtgaggcattggctggtgtggcggatgctggccggtcgtactggtgtggctcaggcccctatgtccatcgtggctcggttcctgggctgttcttcgcgccaggtctctcatatccgtggggctctcgttgatgccggtctgctcggctgtgacgaggtctcgggggcggcgagccgggtgtggttcccctcgatggccgaggagtgtgcagcggatcgtgaggtggtcgatggggccgtcgtcgatgctggggtgggctctggtgaaggtgtcgaggagggcggggaacccctgtcgattttgtccacccacccctg

SEQ ID NO: 334 - DNA, 1639 bp, Propionibacterium acnes; identical to SEQ ID NO: 332

SEQ ID NO: 335 - DNA, 1202 bp, Propionibacterium acnes
ccggagtatctggacaaggccgtgctcactgcgttgtatcccgatgggttgcccttcgacgaggacaccgaggagccgggcgagaatgccgggcaggaggagcttgcgatgactggatgagcccgaacatggttgaaggccgccccgccaggcgaccttcaatcaatggtttcggttgtcagctgcagccacccttgccaggtgctgtggttcttctccagaggaggagggaccgccatgaagacccagaagatctagaagatccaaaagaaccggtttcggctgttgcttcggtcttcatggtagctgatagcccgcgtcgttggaagtgcgacgacgccgatcctcatcggtatcgcaccctgttccagggtcgagaatgtgaaggattaacaaccatgacaagtcatgagacgccctccctgagggcgtcatgaccgctttaattcaagctctgccgacagctgaactgtctgctggacctggtgctagcagtccagctagaccctctgctgagggcttcatcaagattcatcacgaccttattagtgcgggcgtgtcgggtaacgcgatggcgttgttcgtcgcgttacgtaaccagcccggctgtgatcagtggacccgtcactcgtacctgcggctagcccaatggtgcggctgggatgggctgtcggaggcggcgggctgtaagcgggtgcagcgggccgctgctgagctcgctagcggtggttggctggaatcgcgggtcggccatgatcgtcgcaccgctaagacgctggtgtggcatcggttgaccagccccgacaccgaccgctgggagcaattgccgcggattgtgtgggcgaggatctgccagatcgccggggagacgtcgggagagtgggtgaggcattggctggtgtggcggatgctggccggtcgtactggtgtggctcaggcccctatgtccatcgtggctcggttcctgggctgttcttcgcgccaggtctctcatatccgtggggctctcgttgatgccggtctgctcggctgtgacgaggtctcgggggcggcgagccgggtgtggttcccctcgatggccgaggagtgtgcagcggatcgtgaggtggtcgatggggccgtcgtcgatgctggggtgggctctggtgaaggtgtcgaggagggcggggaacccctgtcgattttgtccacccacccctgtc

SEQ ID NO: 336 - DNA, 1641 bp, Propionibacterium acnes
tattcgtccagatccgtcaagtcctcaaccgtgcctccctggaaaacgtcgacccgtggaacgggctagaccggctagccgaggacatcaaactgcccgaactcaccgatgtggtctccatcgcccgcctccaaaacgaaggcgcctccctcgtcgacagtttccgggcccgagtcgccgagttacgcgacgcctacctgctgcgcctgcaacaagaatccaccgccatcacccagcggcttggtttgtggacgatcctgcaagccggctcggtcatgctcatcttgctgggggcggccgccctcacactcatcacagccggataaaccgacaccgtgtcgagcccccatatgggccgcgaacctttcataatgatgcctgtaagcaccacaatattgatcacaacctaacaatgaaggagaaatcatgatgaccgatctcgacctggctaaaaaacagatcacctggctggcggcgcacctgagttcccggatcgttgacgagcgtggcggtggtagctctaccgtggagacactgatttggattggtgtcatcgtggcgctggtgattggtgtgggcgtcggggtgacggcctatatcaggtcgaagatgcctcactgacgacgatgcgtagcaggttcacaactgatcagcgtggcggtggtagcgcgtcggtggggatgctcctgctgatgcctgcgatcatgctgctggcattcggtgggatcgaggtcgggatgtggtgtcacgcccatcagtcgaccatcgcggcagcccaaagcgccgcggaagctcagcgtgtcgtccatccggtcccggggtcggcacaggaggcagcctcgcagatcactagtcatggcggggtgcgtgatacccggatatcggtcagtgatgacggggccactgtcacggtgaccgtctcaggtcgggccccatcgatgctggggctgcatcttccggctgtgtcgtcgacagcgtcgatgcccaaggagcgcctgtcgtgaggcgaagtgagcgcggcggagcaagtctaagcgtcgaggtgctcatgtgggcgccgatcgcgctggtgatcatcgggtttgttgtgggtatcggccggatgtcgatggcccaggacgcggtgagtggcgcggctggtgctgcggcccgtgcggcgtcgttggagcgtgatggacagtcggctcagtctgcggcgcagcaggcggcgtcggcgaacctgtcgtccggtgggctggcatgtgcgccgagtgtgagcgtggacacgtcagtgtttgcccgtcctgccgggcaggcgggcacggttcacgccacggtcacgtgtgtcacctcgctgggtcttggattcgggtcccggacggtgcacgcaacggggtctgccccggtagacacctatcgggaaaggagaggctgagatggcccgcgatgagcgtggtggcggctcggtgtcggtgtggatgctgctcatggtgccagtaattctggtcatggccggcctggtttttgacgggtcccgtcagatatcggcaacccaggcggcccaggacgcggcggttgcggcatcccgcgccggaactgatgcggcagcgacaccgcagctagctggccacgacggggcggccgtagcagtccaagcggccc

SEQ ID NO: 337 - DNA, 1630 bp, Propionibacterium acnes
tctgcccagcgtttctcggcgatgtcgatcatgtcttggatggttttgacccatcctcggatgggatcgactttggtcagtttgatcccttcgaggaactcgatgggctgggtgatgggcccatctggtccggcttcggtgtcccagccttcgtcgatggctagtttcagttcggcggtatcgacccatgtttcgtgggtggtgccgggcacgttgggccaaaaccatcctgctcgtcctttggtgcgtttgaccggtagtaggccgatgtcgtcccaccaggatggcacggtgaagcggatgtggtagcgggccgggtgccaggggttgttggtgaacaggtcgcgggcttcggtggcgctgagcagagtggcgggtgcggcaccgatctctccggtcactgatccggcatacatgaatcggccgtcgatgtacacgaagttagggatagggccggcaggcacggtggggcgccagcccttttcgcggtcctcggggttgccgtcgtcgacgcatagttcgtagcggtgctgaggggaggtgtgttggatgagtgcgcccagttcggggtccatcggctccatgcgataggactcgggggtccgtagcttccagaggttgattccttctgctccggggcggtccatgagggcccagtcgcggtcgattctggtggcgatgatgtgggttaattcgcgccatgcccagcgggcctggattggggtgagggtctggccagggaaccattcatcagcgaccagaatgtcgaggttgcggtcggtttctttgtgggtgaaccggcctcgggcgggccgcccggacagcatgaacaggccccgcacgtgccagtcctggttgaactcgcgggtgtgagcgggggtgtcaggcagcagccaggattgaggctggtcggggatgttaccgcagacgatcaggcgtcgggcgttgtggtgtagcgcggttgttagcaggtctgacagggtcgcgtgcttggtgcgtcgtccccccagcactggcaggatctcgtttccggccgcgtcgactccccgggcggtgtcgatgtctagccacactgtttcggggtcggggggccgatgtggggcgggacggcgctgctcctggtcgtctctcatggtttcctcctttgggccagggagcggccggcgtcgagggcgttcatgcgctcgcgttgttcttcgcgtagttggtagacccggcctcgtgacactcctgctgcctcggcgatggtggtggccggcaggtggccgatggcggcagcgtcggcaaggacgtcacgccaggccaggtcaatggttcccagctgggctagagcttcgtcgcggcggcgggtggcatcagccactacggaggcccaccctgtggggtggatggtcttgacgacgattcggttgtggcggatggggccccatgcatcagcggggacttgccagccgtgattggcggcggactcggtgatcttgaggcgtcgctcaggtgcgcgggtgcgggcagtgacgtcggtgttccaggtctggactggtacccacgtcccctctcggatgcgttcgatgacgcacgtggtgacctcgtcggtgactgtgatgaccagacgataatctttcccgtctgg

SEQ ID NO: 338 - DNA, 1643 bp, Propionibacterium acnes
gcgagccacgaccatcgccaagctgaatggagagcgagcatgagcaccacccctgccgggttcgacttcgacgctctggccgagtgggccgagagcgatgaggcgacccacaccccgcaaaccagccccgtgttccggggcaaggacgccgcgcgcgccagccgcgcattcctcggccgaggacggcccaccctcggcgcggaccacgccaccggcgagggccggtcgccccgccgtcaagtacggctcgacgcacgcaccaacgcgcgactcgacgcctacgcagccgcaaccggcaccagcgcctcccagatcatccgcgacgccctcgctgactacctgcccgcctgatcccaccccaatccactcgggcgcctgtcagtgccccctcttctgggtggtggtccggggcgtcaccgccccggaccagttgggtagtcatctcagttgaaataagcgattagtgatacgcccctcctgctttccggtgctgtcatgagcgtctgacaacagcgacacctcggggcagccgacggacagtcctctggctgccgctctgatcccatgcccacggcacgaaggtgtcggacagctcggtctcatcatgtgcccaaatagcgtcgtgggcctgtcgccaagcttctcgggagccccacacgggcacgaccgggccacaccggtgtcctggtctccagtgtcgcgacactgtcgatttcggtacgtgcaatgcggcggcggtttgacggatcgacatcccagactcccgcgcgtcccagatcgccatgtggagagtatttgcctccagtgcggccgccacacttgcacgctctcgcgcacgctcgaatgcccgcctagtgctctcaaatgtcgtcacgacgcctccccctgaaaatactcagggtgtcccacggtgggacaccctgagtatttcataccccaactcgcctcaccacacgtcgacctcgacaccgatcaagcgacccgtatcagcgacattgccgtaccgctgacccgcctggtcctccagccacgacaacgcatcccgaaacagcccgacgtcttccaaagctaaaccacagtcgtagccgcccttgtcccccaaccgcaccatctggcgctcccggtggcctccctcgtcgacctcgatccacagtttcgcgtgcatccgctggcctcggccctctgacaggatctcggtgagcaggtcggacgcctgccctcgcgcatcctcgttactgcgggggaattggagtatgtgggaggaacgatgatgggggaggttggtgacctcatggcgcagcaggttgcgcttgtgcatctgctggtcgagacggtcgggctgacctgttgacggggttgagccgtggcgccgcttcctcggcggggtctcgatccgttgctcttccggcggttcggcgtcaggttgtggtgcgcgatctcccctaggacgggggggcttgccacctatatccgagggacgatgagacggccttccacgcttgctgcgcactttcgcagcccgccccttgcggtcacgccgacgcggcggcggagtgacgtcctcaccgcgcgctaactgcgtcaacgcctcgaccaggttggtgcccggtttcagcccttttagcacgaaccgcaccaggcgg

SEQ ID NO: 339 - DNA, 1583 bp, Propionibacterium acnes
gaacggggcatgggattagccgaggcgctgcgcgaggggacggcccttcccccaccacagcatctcagcgaaaacctccacctggtcagtggcggcccggccctccacgagttcaccgaccccgcatccttagcggccatcatcgaccgagtcaccaccgcacgctacgacctgctagctcaggcccttgccccgctggcctgggactatgacctcatcttcatcgactccgggcctgcccaaactctgctgtcccagaccatccttggagtagcccgctggctggtagtgcccacccgcaccgataacgcctcaatcactggcctcgtcgacgttcaagacgccatcgacggggttgcctcctgcaaccctgaccttcaactactcggcgttgtcctagccggcgtgggggcccgggccacccggatcgccgcagataaacgccacgccatcgacacagtgctgggggcaggaaccgttttcgatgcggtcatccactactccgagaaggtgtccgtgctcgcacgccagcagggcaagaccgtcgccgagctagccaacgagtaccacaacacccagcccgcctacacctacctagctaaaggccagaacatccccaacgtcgccaaggcagccgtcagcatcgaaactgattatctgaggctggccaccgagatcagcgaccgcatgttcaccagcgacgagcaggagcctgatcatgactgacgatccgactccatccgagcagaacaaccccaccagcgacgacatgcgcttggccgaagaatgggccaacagcggccgcacagtgggagccctgccgcgccgtcaacggcctcagcaacccacaccccgcaccaccagccaaccccctgtctcgtcccctgacacaccggctccgaaaaaaccccagaagacccccaccagccagcctggccgtcaacggatcaacgtcaccgtctacgttgtgcccgaactccatgagcggctgcgctcccgatcggcggcgacgggggtgacggtctcggatctggtggtgcatgcgttagcgttcgtcgccgatcatgcgggggaggcgatcgccgatgatctgcgcgtcgagacgggccccggcatgggggccggactgttcgatgtgaccccatcgcggccagtaggggtcgccaaaacccagctgggggtgcgaatgacccgccacaacaagaatggcttggaccagctgacccggacgagtggagcccgtgaccgcagccatcttgtgtctgtcgccgtgcgcgactatctcgactccaaccctgtaaagaaaggccgacatgtccgctgatgaaactcctgccgcccggggtgggcgacgctttgatacgaccgtcaagcccaggcgccgtcccatgcttatcgccgccggtatcgccatcgtgatagtcggcgcgctcctcatcactcagttgattcgctccgcccaaaccgagcatcgcgtgctggaagtccacgccgatgtggctcgcggcgaggtcatccgtgacaccgatctggtatcggtgactgtcggccaggtcgacaacgtatcaacggttcccgcagac

SEQ ID NO: 340 - DNA, 1551 bp, Propionibacterium acnes
gctgagaaaaattttgggtccgccctgcatatcggggcctcttcataccttcaaaagtgtgaagggaatacagactcttcgactggaattaaaatggtatatggcgtgtccggtccgcacccagctccacgatgcgccatagaggagccataacttcaccaatcgtatacgatatgagtgtaggtgagcatctaccggtggccgacagtcagatacaagcatgggcggatgaagcagaagctgattatgacctcagcatgcttccgccgtctcgacgtggtcgcccaccggtggggaggggcccgggcactgtggtccctgtgcgcttcgacgcggacactctcaaggcgttgtcacaacgagcccctgacgaaggattgaccacgcgttctgacgcgatccgtgctgcggttaaccagtggctcggcctcggctcgtaaacattatcggcgcgacaaccttactgatgacgctgttggttacgccgtagagcacatcttgtactcgtgggcgctcgacgatgccgatgatcctcgttgctggatgatgattcggtgttgacccagctggcctcctcatggagctagttatcctcatctacgacgatggctatgaactcctgatccacgccatgaaagcccgccctcagtatctgagctacttcgctatctagtgttgttgggcgagttgaactcaacttttctccgacgcaagcgccaataaaaggctgatccatccgaataccaccaaacacggctgaagtgtggaacagattcagcaagacagggtgcggtgctcgggtgcgttggggagatgaggatattcaggcttctggcgggatgtggcttgatgacgtccaggatcaccggttcggttttgaaggtgccttgcattaatgtcgacagggtcgtacgactcgaggactggatcgaccagcccgttgcgtctgaagaacttcatccaccccggtggagctccggccgcgtactggtgcaacggatcattagcatgggtagcgtgagtatgccttcgatcgtggtcagtgctgtcatcatccaagattctgacgggcggcttctcactgtccgtaaacgaggcgccgaggcattcatgctgccaggcggcaagccggagcccggcgaggactcgcgtcaggcagtagtccgggaagtgcacgaagagctcggcgtctcattgtcttccgacgacctgcgtcgggtgggagtgttcaccacgcgagcagcgaatgaggccggccatcaggtggtggcgacgattttcacccacaccccggttgcggtgagtgagccagctgctgagatcgagcagattcgttggctcgattggagtgtcgacgccctgcctgatgacctggccccgctgctggtcgaggcagtcatcccgtggctgcggcgccgtatccggtcggtcgctgtattcacgggtgcgaaggatggaaccgaccctcattatcgtgtcgaagcaaccgccttgggccggggtctcgcacacgccgggatcaccctggtttatggcggcgggaaggtcggg

SEQ ID NO: 341 - DNA, 1546 bp, Propionibacterium acnes
gctgagaaaaattttgggtccgccctgcatatcggggcctcttcataccttcaaaagtgtgaagggaatacagactcttcgactggaattaaaatggtatatggcgtgtccggtccgcacccagctccacgatgcgccatagaggagccataacttcaccaatcgtatacgatatgagtgtaggtgagcatctaccggtggccgacagtcagatacaagcatgggcggatgaagcagaagctgattatgacctcagcatgcttccgccgtctcgacgtggtcgcccaccggtggggaggggcccgggcactgtggtccctgtgcgcttcgacgcggacactctcaaggcgttgtcacaacgagcccctgacgaaggattgaccacgcgttctgacgcgatccgtgctgcggttaaccagtggctcggcctcggctcgtaaacattatcggcgcgacaaccttactgatgacgctgttggttacgccgtagagcacatcttgtactcgtgggcgctcgacgatgccgatgatcctcgttgctggatgatgattcggtgttgacccagctggcctcctcatggagctagttatcctcatctacgacgatggctatgaactcctgatccacgccatgaaagcccgccctcagtatctgagctacttcgctatctagtgttgttgggcgagttgaactcaacttttctccgacgcaagcgccaataaaaggctgatccatccgaataccaccaaacacggctgaagtgtggaacagattcagcaagacagggtgcggtgctcgggtgcgttggggagatgaggatattcaggcttctggcgggatgtggcttgatgacgtccaggatcaccggttcggttttgaaggtgccttgcattaatgtcgacagggtcgtacgactcgaggactggatcgaccagcccgttgcgtctgaagaacttcatccaccccggtggagctccggccgcgtactggtgcaacggatcattagcatgggtagcgtgagtatgccttcgatcgtggtcagtgctgtcatcatccaagattctgacgggcggcttctcactgtccgtaaacgaggcgccgaggcattcatgctgccaggcggcaagccggagcccggcgaggactcgcgtcaggcagtagtccgggaagtgcacgaagagctcggcgtcgcattgtcttccgacgacctgcgtcgggtgggagtgttcaccacgcgagcagcgaatgaggccggccatcaggtggtggcgacgattttcacccacaccccggttgcggtgagtgagccagctgctgagatcgagcagattcgttggctcgattggagtgtcgacgccctgcctgatgacctggccccgctgctggtcgaggcagtcatcccgtggctgcggcgccgtatccggtcggtcgctgtattcacgggtgcgaaggatggaaccgaccctcattatcgtgtcgaagcaaccgccttgggccggggtctcgcacacgccgggatcaccctggtttatggcggcgggaagg

SEQ ID NO: 342 - DNA, 1496 bp, Propionibacterium acnes
gggaatacagactcttcgactggaattaaaatggtatatggcgtgtccggtccgcacccagctccacgatgcgccataggggagccataacttcaccaatcgtatacgatatgagtgtgggtgagcatctaccggtggccgacagtcagatacaagcatgggcggatgaagcagaagctgattatgacctcagcatgcttccgccgtctcgacgtggtcgcccaccggtggggaggggcccgggcactgtggtccctgtgcgcttcgacgcggacactctcaaggcgttgtcacaacgagcccatgacgaaggattgaccacgcgttctgacgcgatccgtgctgcggttaaccagtggctcggcctcggctcgtaaacattatcggcgcgacaaccttactgatgacgctgttggttacgccgtagagcacatcttgtactcgtgggcgctcgacgatgctgatgatcctcgttgctggatgatgattcggtgttgacccagctggcctcctcatggagctagttatcctcatctacgacgatggctatgaactcctgatccacgccatgaaagcccgccctcagtatctgagctacttcgctatctagtgttgttgggcgagttgaactcaacttttctccgacgcaagcgccaataaaaggctgatccatccgaataccaccaaacacggctgaagtgtggaacagattcagcaagacagggtgcggtgctcgggtgcgttggggagatgaggatattcaggcttctggcgggatgtggcttgatgacgtccaggatcaccggttcggttttgaaggtgccttgcattaatgtcgacagggtcgtacgactcgaggactggatcgaccagcccgttgcgtctgaagaacttcatccaccccggtggagctccggccgcgtactggtgcaacggatcattagcatgggtagcgtgagtatgccttcgatcgtggtcagtgctgtcatcatccaagattctgacgggcggcttctcactgtccgtaaacgaggcgccgaggcattcatgctgccaggcggcaagccggagcccggcgagaactcgcgtcaggcagtagtccgggaagtgcacgaagagctcggcgtcgcattgtcttccgacgacctgcgtcgggtgggagtgttcaccacgcgagcagcgaatgaggccggccatcaggtggtggcgacgattttcacccacaccccggttgcggtgagtgagccagctgctgagatcgagcagattcgttggctcgattggagtgtcgacgccctgcctgatgacctggccccgctgctggtcgaggcagtcatcccgtggctgcggcgccgtatccggtcggtcgctgtattcacgggtgcgaaggatggaaccgaccctcattatcgtgtcgaagcaaccgccttgggccggggtctcgcacacgccgggatcaccctggtttatggcggcgggaaggtcgggatgatggg

SEQ ID NO: 343 - DNA, 1526 bp, Propionibacterium acnes
cgcacggctgctcgcacccatggcggccgccagatgcgcgccgcctccacccgcgtcctcaccatgtcctgcgcaatcgtttgcgccctaccccgaaggggtcaccactacaggaaagttaagttcctagatggtcaccaacgcacgcgcaggcgcgtgcgaaggccagcaacaccagagaagaaacccctgtggctgcaaaaactcgcagccctcctcgaccagcacctgccctggctggtgagaaaccatcacatcggccgactgtgccacgccctcaccgccctgggcatcgacgaacactggcaacccgcagacctcgacgccctcctcgacgccatgaaccgcaggaaccgtcgcctcggcctcgacgtgccatgcgccgacgaccagcacaaccccttgggactgttcatccaccaggcccgagacaccctcacccacgacaacccccatgaacgccgcctggcccgcgaacaccaccgcgcccaactcatcgacgaccaactccgccgccgcgcagaaaccgccacctgcgcagcccgcctcgcagccgagcacgccgaccccgactaccagacccgccgtcgtgaacgcagggaaaccctgcgagccacactcagggccgcccagcagcatgtcaggacacactgatacccgctcatacacacaccatgaaacacgacaagccacctgacagtatcagctgcaagacgcatgacaacatagaaggatatgatgaaatacacatagacacaacccagcacagcagtttcgcaacaaatcatgatagtctcatggcagtatcgcttgatacacacatagcatcactcccacataggcagttatgctgatatactcctactaggttatccgtccaacatgctgagtgggttcctgtacagcatgaaaggagcatggcatgatatgggccgttctcaactgcaagggtggtgtcggcaagacgaccagtgccctcctgctggcggcagccgccgccaagcagggccacaccaccctggtggccgacgctgacccccagggcaccgcatcccagtggtcagccctggcaaccaaaaacgacgaacccctgcccttcccggtgcaagcggtcaacatcgccaccatggaggcactgcccaccaccaccgacgcccatgatctcatcctcgttgacacacccccctcggcaggcgatctgatgttccaggcatgccgcatcgccgacctcatcatcatccccaccgccacctccggacccgacatctcccgaacatgggtcaccatggacgccacacaaggcacaccacgcgcgatcctcctcacccaaaccgaacacaaccgtgtcgtctaccgccaagctcgcactgccctcgccgccgacgacaccgtcgttctcctggaccacgacatcccccgccgtgaatccatccgcacagcatggggcaccaaccccccagacgacgtcatcacctactacctgcccgtcctcaacgaactcatggaggccctgtcatgaccaccaa

SEQ ID NO: 344 - DNA, 1473 bp, Propionibacterium acnes
cagatcactagtcatggcggggtgcgtgatacccggatatcggtcagtgatgacggggccactgtcacggtgaccgtctcaggtcgggccccatcgatgctggggctgcatcttccggctgtgtcgtcgacagcgtcgatgcccaaggagcgcctgtcgtgaggcgaagtgagcgcggtggagcaagtctaagcgtcgaggtgctcatgtgggcgccgatcgcgctggtgatcatcgggtttgttgtgggtatcggccggatgtcgatggcccaggacgcggtgaatggcgcggcgggtgctgcggcccgtgcggcgtcgttggagcgtgatggacagtcggctcagtctgcggcgcagcaggcggcgtcggcgaacctgtcgtccggtgggctggcatgtgcgccgaatgtgagcgtggacacgtcagtgtttgcccgtcctgccgggcaggcgggcacggttcacgccacggtcacgtgtgtcacctcgctgggtcttgggttcgggtcccggacggtgcacgcaacggggtctgccccggtagacacctatcgggaaaggagaggctgagatggcccgtgatgagcgtggtggcggctcggtgtcggtgtggatgctgctcatggtgccggtgattctggtcatggccggcctggtttttgacgggtcccgtcagatatcggcaacccaggcggcccaggacgcggcggttgcggcatcccgcgccggaactgatgcggcagcgacaccgcagcttgctggccacgacggggcggccgtagcagtccaagcggcccgccaggcactatctgctgccggggtggacgggtcggtgcaggaggacgggtcgaccatcacggtgaccacgtctcaaagtcggccgacagtgttcctgtcagcgatcggaatcagccaggtaagggggcatgggcaggcccatgctcagcttgtgggaccgggagaacgcccatgacagtgatacgtcgtatcggtgccctggtggcactgcttgtggtgatagccggcttaccggccgggctcgtggccgcaggcgccccgctagtaccggcgggcctgtcatgggcccatgtgcggcatctgttggttaccccagacatgaccgggtcggtgctggtgtggctggtcagcctcatcggctggatcgggtgggcatggttcgccctggccgtcgcagccgaagcggtgacgatgctctcagggcagcggctgcactggcacatgcccggccctcgcctagtgcgccgagtggcagccggtcttctcattgccgcgttcgcggccgcaccggcagccacaagcacggctcacgccgccgaggccacccatgtggcggtcgccgcccaggctggaccggcacacgcggcccccgcccaggacagccccgccaccacctctcaggccccggacgcctccaccactccgaaaatctggaagacctacacggtgcggg

SEQ ID NO: 345 - DNA, 1515 bp, Propionibacterium acnes
aaactggccgggatgaggatgacggccgcgccgacacttcggagcgaggtcatgtgacgatccttcggtagctcgacgggttgccgtagatcttttccacgttgatgccactatgtgggttgtcggcgctaaccatttggcctccaccgatgtagacggccacgtggtgggcagggcttccccagaggatgaggtcgccgactttgagctggtcacgggccacagcagtgccgactttctgctggtcggcggcggtgcgagggaggctaatgccgatacgccggtacagcgccgaggtcaggcctgagcagtcgtagccgccatcggctttgccgttgccaccccacacgtaggcgtaggagttgttgtcggcgatcgatttggcccatgccacggcttcggccaggttcttcgacacaccggtctcgttagcggccccggtggcacagttgtttgacaggtgccctgtagtagtggatcccactatttgtttggccatggtttcccatttggcgtaggcatcgggcagggctgagccttgcactgcctgagctgcctgcgtcagcggcatcttctgccagtcagcgatgtcgactaaaccgggaatgtggaatccagggccgccggccgatccggggccagcgtaggtgatggtgtggcctttcaagaacgcctcggtggcgtaggcatcattgttgacctgatccagagtcccgtaccagcccggcaggatgcgctgctgaaaggggccggcgtcaccgtcaccgttagccttcgctgaggtagggtcggccccaagatctgattcttgtttggcggtcatgatagcgatgaccgctgcctgggtaggcagtttgtcacgctggaccacagtgacgatggtggtcacgagctgcttctgcctggccgtgaggcctccggcacccacagtgcctccggtgacggtacccacgcaagcatccccgccgacactgccaccgccgccgccagagttgtcgtcgagggccccagagcctactgacagcagcggcacaatgatcacggtcgctggcaagaccgccaggcccgccagcatcagcactgctgcactcaccacggcgatcacgtgagatgctttcaacgctgcccacctctcgctggtttgagggggcgacgcctgctggtacgcacaggcttggttgatccagtccgccgttgattggcaggcctgggtttgatcggcttgctgggacccggtttgggctccggagtcttaggctccggcttcacatgcctaggcacttcggctgcggtgggaggagtcagcacgtggcgtaccggcttggtgaccttctgggcacccgaaacaaccggcttagacaccaccttggcacctttgaccaccggtgcggctgccttcgcgccggccttcttgactgcacgatgcgctttgatagccccggcctcggcccggccaaccctactagcagtagcatcgagggctctgtgacccgtcgttgccctcaccggtgcatc

SEQ ID NO: 346 - DNA, 1791 bp, Propionibacterium acnes
aagggtggcctggtacccggggaacccgcacccgcgaccctgtcgaactacgccaccggccaggccctcaagaactacatgaccttcatgcaccaaatctcgggtctaggtctcacatggaagtcgggagcctcaaagatcactgtggtgcgggagaaaaagggtgataccacctaccccgaggccgctatcgccttggaatcgtgcgaagacggcagctccatccgatcggtggaccgccacggacaggctgaccatggccggctcacacacgtcgacagttggtatgcccgcgataagaagggcaccatcaaaatgatcgcacgtaacggagtggaggtttcctcatgcgacgtcaagtaatcaccgcggccgtgctgggcctgaccctggccaccacctccctgcccgccctcgcagataatggagacttcagtggccatacagacacggatggtcctggttacgatgtgcgtactgaggtggattaccatcacaccaccggtggtgcgggtgggggtgccacgacagggggccatcatgggggcaaaacccacggtgatggtgaaggtgaggctattgatgggcgttctcgcgccgatgccgaagccgaactagacgaagccgaccgtaaccaggacttgacttgtgatgtcatgctcccaccggcgccgaataccccagccggccaggaatgggcgaaagaatgcaatcccccagcgaaaaaggggcagaaggccaccccgaagcccgacccggtgttagtgggccgtcacgcagccttgcagctcacccttcccggcgcggcccctcgtatcgatccgtcccccgaccttaaccggtggcactcggcagcagtgggccaggctttgtggttgtcagttgatgaccccaccgccactacacagaaatcgatcacgtttatgggccaggttgtctcgttgagcgccaaacgtaacggtttgtcgtttgatatgggtgatggtcatgtcgtgcactgtgatgccacgacgacatggacggagtcggtggaaccggggaccccctcacccacgtgcggttacacctaccaacaggcagccccggccgggggctataaggtcaccgcaatcacgtcgtgggatgtgacctggtcggtactaggacacacgggcacagtccatatcgagaaggccggtgggcagatgcttccggtcggcgagttggagtctgttgttacacggcgatgactcctgatagtccgacgctgtatgaggtgttgggggtctgccctgatgccactgatgaccagatcaagacggcgtggcgtcgtgccgcgaaagtgactcaccctgatgccggtggcactagtgaggcgttcgcggccgcccggcacgcctgggaggtgttgtctgatcctgcccggcgcaccgcctacgatgccgacctggcgggggaggatgatcccgacgacgaagccgccgacgccttcgacgttgatccgttcacggcatggccctggtgcgccccgtacatcgacgccacccccaccctgcgccacacctgccccggcacgatcaaggccatcgtggtcgccatcgccgggatcatggccggaatcggctggcaggaagcgctggaggccgtggtgtcgccgccggggtttctgggggcgtgctggatagtctcagtgccggttgtcgtcgcagtgacatggctggcagcggtgacgggtctggcatttttcaccatggcggccatctggtgtggatggtcgttgataggtggtgcgttgctgtggggccagacgtc

SEQ ID NO: 347 - DNA, 1079 bp, Propionibacterium acnes
caggtgggtttgaccgccagcgtcggattggtgctggtcgctgggctgatcaccactctcaaccgtcgttaccggacccggttcacccgtcagccccgcggcaaggccatgaccctgcccagcccggacgcccaaactgccgagatagcgctgcgcagcaccggggcgactgacactctgacgatcacctgcctcgaccaggcgctccgcgcgatcggcgcatggtgccaccactgcgggcacccgctgccacccctgctggccgcccgcgtcgatgacgaccggatcgacctgctgctatcccaggcggcccccgaccatcccgaggcggtggagctggccgccgacggatcggtgtggaccctcaccgccgaccggatcgacgacctgctagcccacaccgatgacaaccaagcggctccgtggccgtctctggtcacactgggacgcgacgacgacggcgcccacatcctcatcgacttggaagccgcaggaaccttgcacctgatcgccgatgacgaccaggtcgacgcggccctcgccgcgatcgccgtggaactggccacctgtgactggtccgacgaggtcaacgtcaccctggtcggccaggtgtgcccgggcctagaagacgcactagagtctccgaccctgacccgcgccaccgacgtggacgccctcctcaccaccctggaagctcgcgccgacgaccagcgacacatcctcaccgaaggaagccccctcgccgctcaccgagccgaccccgccatctccgacgggttcgacgccgaagtgatcctcctcgacaccgaactcaccgaagaccaccgcaaccgcctcgccagcctcgtcgaggctcttccccgcgtgtcagtcgccgcggtaacaaccagccccaccagcccagacgaatggtccctcaccctgacaggtgacccactagccgccgacgtggctcccctcggctggcacatccacccccaaaccctctcccccgacctgtacaaccgcgtggttgaactgctagacaactctgcggccgacgactacgcacccgccgactggtgggaccatgacgccga

SEQ ID NO: 348 - DNA, 593 bp, Propionibacterium acnes
gctgagaaaaattttgggtccgccctgcatatcggggcctcttcataccttcaaaagtgtgaagggaatacagactcttcgactggaattaaaatggtatatggcgtgtccggtccgcacccagctccacgatgcgccatagaggagccataacttcaccaatcgtatacgatatgagtgtaggtgagcatctaccggtgaccgacagtcagatacaagcatgggcggatgaagcagaagctgattatgacctcagcatgcttccgccgtctcgacgtggtcgcccaccggtggggaggggcccgggcactgtggtccctgtgcgcttcgacgcggacactctcaaggcgttgtcacaacgagcccatgacgaaggattgaccacgcgttctgacgcgatccgtgctgcggttaaccagtggctcggcctcggctcgtaaacattatcggcgcgacaaccttactgatgacgctgttggttacgccgtagagcacatcttgtactcgtgggcgctcgacgatgctgatgatcctcgttgctggatgatgattcggtgttgacccagctggcctcctcatggagctagttatcc

SEQ ID NO: 349 - DNA, 1791 bp, Propionibacterium acnes; identical to SEQ ID NO: 346

SEQ ID NO: 350 - DNA, 1079 bp, Propionibacterium acnes; identical to SEQ ID NO: 347

SEQ ID NO: 351 - DNA, 593 bp, Propionibacterium acnes; identical to SEQ ID NO: 348

SEQ ID NO: 352 - DNA, 1515 bp, Propionibacterium acnes
tggaccaggtttgcggggcatgcgcgcatcggtgatcttggccgccaccaggtgttccagattgtccaagtgcccggagtcagaggtcagcagaagagtagtcacctcgaccgcggtggctgaggcgatctgagctgtgcggcggtcgtgatgggtggtgtcagtgctgacagctgtggtgggagcggatgccggggccgccgaacggaccagggcaacggggccgcatgcgactccgcacagcacgagggcaaggaagcctttggtggccatcgatccggtgtggggccagggacccacgttttcctgtgcctgttttttcttggccgaccaacggcgggacttagggttagcggatgcaccttctggggtgcatgctcgtctcaatcgcatcggtcacctccttcactggatgaagggaccaaggaggtgaccgatgtgcggtcgaacccgaaaaagttcaaacttttttctgggtctgcctcaagtacgacagaaggcctgcatcatcacggcgttgtggtagcagatcttgcgtcagcgcaaatgcatgggcctcgtaggagtagctcttaggtaggtcccggtggttgcggccagggcgagggtgtcgggtatgtgtagcgctagtcccgggttcgtggtgtgagggcttttgggtgctgacatgcactacccattgctagacgctgtgctgtggcatggctggacgtctagcagacgggttgacatcacctttaggctggcagcgcccgaggccgcaggccagaggaagcggacagcctaacgattgacgtccccctctcctttccccaacctcctggagtcgatgacccggagatagatcgatgtctatgcatcggtgcatcgatatacctatgtatctgtctgtggtttttagaggccactcccgtcgccccgggccgctcagcgataccgcaaggctgtgtgggatcagctgtgccgctcccccgacatggcagacagcaccgttgcatgagaactgactgacactgtggcgccgcggaggtctcccgcggcgtccgctggggcgagtgcatgcctgtcagctcatcttttatcgtcatgtttccccttgtcagagcggtctttgcaaagtgacaacgtcaggggtcttgacgacaacatcctcgacaacatcgtggcggtggtctgtgtctcgtcagttcaacgcaccggggaaagaggcaccgctgatgttcaccaccacaaacaccctcaacgatgaatgggaccagattcgcgccactgagatcgattggcatgactgccctgaactgatgcactgcatcgacgttgatgatgtgttggccgtcattcctgccgcccccgacgccatcttgggctacctcattgcccgggctcagggcggtgacgagttggccacccgcactatcatccaagcgttcacaggcaagcttattttgatggccacggccaccaaggtgcgccgtactaatgacggcttcaatgatctgttggcgggtctgtggg

SEQ ID NO: 353 - DNA, 1766 bp, Propionibacterium acnes
ttaactagggtcattgtcggtgaggtgcgcggcaatgaggcctcggccatgttccaggccatgcagtcgggtacaggcaccatgagcagtatccactccccgcgagcctctgaggtgccgtcccggctagcccaaatgatttcgatgggcccggtctacgatctggatcaggccatgctgcagatcggtcattcgatcgactacatcgtctttgttcgtaagcgtgacctgcctgatgggagccggctgcgatttgttgagcagatccgttcagtctcgcctggtgattcgacaactcccagtcttggcgaggtgtacacggctgactcgtggacaggccagccgcttacgccactcatgcctggttcggccgccgacgagctgtctcacttcgcccgagacctggattactgcgaggcccactcatgaacactcccgcactaaccagcgccctcatcgtgaccgggctagggctgatcctggccatcgacgggctggtcccggcgccgcctcgacctggtgccccgctgagcccggcccaaaggtgggctcggctcacccaccgtcccactggtgcggccgggcgtcgccgggatttgcgttgggggttggctgttcttgtcggtgtcgtgctgtttgtgctcaccgggtgggtggctgcgctggcgctgggccccatcattgtgttgttggcccccaccctgctgggggcggccccaccgaccgatattccgctgatggaggcgctggatcggtgggtgcgtcaggtcgctgcggtgctgccacaggggcgagacatcatcacagcggtgcggatctcacggccgcgggccccgaagctgatcgccgggtcggtggatcaactggtgtcccggttggatggccgtatggagccgagggaggcgttccagcggatggccgacgagctggactcggctgaggctgacgcggtgctggcctcactagcgttggcggccactcatccgcggggagcctcgacaacgttgaaggctattgctggcaacatccaacagcggttgaaagtgctgcggcaggtggaggctgaacggtctaagccgcgtaactcggtgcgccagatcacactggtcacgatcgccatgttcggggggctgctcgtgatcggacggtcgtttctggccccgctggcgacccctcccggtcaggtgctggtggccgtggcggtggtcatgtatgtcatcgcactagtgcagatgtatcggatggcgcggccccgtcgacgcacccggatcatggtcaggaggacccgatgaccattactgctttgtccctgctagccggggccatcgtcactgtcggactgctggtcatcgtggcagcgttccgcccagccccaggccctgacctggttgccgctctggaggtggtgtcgggtcgcacctcaagcgtcgccgagaacgtcgaccagacccggatcgggcggataggtcgcagcgtgacccgcacattccatgtgtcggtgtccccggccatgcgggccgcactgcggctccaaggcacgacccccgaagcgttctacggtcgacgcctgatctgcgcactgatcggggcgatcctgccgtggctgctcaacgcggtagccatcgcggtaggggcgaattccccgaacctactcatcccttcggcgctgtgtgtggcgttagctggcgctggatggatgctgccggcagcacggttgaaggctgcggccgggcccaccaacgatgactcgttcgaagcgctgctgg

SEQ ID NO: 354 - DNA, 1453 bp, Propionibacterium acnes
catccgtgacaccgatctggtatcggtgactgtcggccaggtcgacaacgtatcaacggttcccgcagaccagctcgactcactggtcggcaaacgcgccacggcagatcttcgagccggatcactcttgcctgctggggctatcggcccggccgatgtcgttccagctccgggcaagtcgctggtcgggctgaagctagccgccggacagatccctatcggagaccttgctgccgggacgaagctgcgcctgatccagacgtcggcacccagcggctcatccaccaccactgatagcagcaccaataccgatggccagtcgtgggaggcaacaatggcgaccggcaccaaaaagaccgagcaggtcaccttgatcaacgccgaagtgaactcgcgtgatgccgcccggatcgcccaactgacgtcacagggccgtatcgccgtagtgaaggatccgatccgatgagcaccattgttttgaccagcgtctcgggagccccaggggtcaccacgacagcgatcgggctgggcagggtctggccacaatcgagcctggtcgtcgaggatgacacccaccacgccatgctggcgggctacctgcgagcctcccagcacgccgaaccgaacctggccgcagtggcgaacctgacgtcgactccaaccaacgcccaaacggtgtgggaatctatcgccagacccctacccaccgatgacccagtcggcgggctgcgacgcaaaggcatcctcggcccgcccacgccgtggtctcgcgcaggcatcgacccccgatggggattcatgctggccctgtggcggcaactggaggaggctggcatcgacaccatcatcgatttgggtcgcctagccacaccactgacctcaacgccacacctgatcgccgcacccatcgtcgaggacgccgacatgatcttggtgatgatcgaggcgacactacgcggcatcgccggcgcccgcacgatggtggagggactcgctgagcagatgaacttggccggcgcctaccgacgtctcggactgcttgtccaccgtggcggccaggcccgcggcgtcgccgagttcaatgacaaggagatcacctcggcgttacgactcccggtcatcggggccattacccacgacccggccggagccgcccaactctccgacggggtcgggcagcggttcgacaagtcacgtctggcccactcactatcaaaggtggcggccagcctcgtcgatgccataaacaagcgccacgctgatgacgaggaggatctgtgatggccagttttgctgataatccgttcgacaagctgcgctcccaggatgcggcaagagcttcggtagagcaggagcctgatgccggattagcgtcggagttgttttcgacgtcgtcggggtgggccagctctcagcaggtgtcccaagctcaaccggtgatgacccgttcgga

SEQ ID NO: 355 - DNA, 1466 bp, Propionibacterium acnes
tctggggagtctgggcccggaagggccacgggtcggggcaccatcgagggcagggggtggcggcgggtgacggtgatggtgtcgtgttccaggtcgaagtcgctgcgccactggccgagcatcatcgccgaggtcaccgcggccaggcgcaattggatgttcgggctggacaaatgggcgccacgttggtggtgaatggtgaagccgtccaggttcccccgatcggttttccaggaatcgacggtgaccgccgacccatagatctgagtggctacttctttagcccgttccttgtctcggtccagatcggttttgtcagggtcaggggtcggggcgcggtattgcaggacgaaccggccggccgggatcgttgcggatgtcaccgtgaactctgccggcgaccaggcagccgcggccgcctgggtgagggccattggcatggtctcgacggcagcctcctcgggggggatggtgagggtcaggcgtcgcggatgcgtcttcttgcgattccatgtgactttctgcctcaccggcaccttcgccgccgactgaatggctaggcgagctgattcggcagtttcggtacgccggccagcgcgtagcgcccgtcgtgcgtgaaggctgcccaccacagcacagcccatacacggcagccaccagcgcggatcagcggctgctgcatagcccccggtagctagtaccgcacctgaccagccggccgcgatacttttccacgccggtttcgcgccaccaggaccagcgttatggacggtctgcttcgaggctgcggagggacgagacagcggagtgctggtcatgccgcggcctccttgtggcaggtcatttcacaggcatgccggccagcgatgatgccgtggcgcaccgccccggtagccgcatagaccgcgcacaactcaaacacggggcacccatcgcaggccgccgggttcatgctttctttgtcccacgatggtgggtcatcggtgcacggcacggccaggccatcctgttgagcggcgctgatagcggtgaataggcgcagctgggcgcgaacttggtctggggtcaggttgacggtgcgggctacacgcatggggttccttcctcttcaccagtgaaggttccctagacccggccgatgtgcggagggatttcagtgttttatcgaggtgaccagccagccggtctgcgctgcgggttcaggtaccagggtcagatgcagcatggtgtggtcggctaggggcacggcgaccaggggcccgtcggcgctcgccccggtgagggtgggagttccggccacggtggtggcgggaatctggttgggtttcgcggccatcagggagcccatgagggtcggggcggcgatctggacgagggcgactttgcgggcggcgggatcgcgggtcaaccagccgcgggtgaaggtgagcgcagccgacgtgatatcggggctcagcggggctggt

SEQ ID NO: 356 - DNA, 908 bp, Propionibacterium acnes
ccccaatgcccccacaacgatcagcacaccaacagcgatcatcaggtgggcagcactaactgatcccaacggaccaagatcaaacaagccctgcccgggagcgccgagcagtccgtgggcgcgaagccatgctccgagattgccaatgatcttggggatcatcttgttcagtagggctatccctccgatgccgacaacgaggaagacgaggatttcttcgcctgcgttgtttcttcctgtgtttgcggtcatgctgccttctcggggtggatggccagccagctgatgaggttgtcggtgatctgccctgagatttggatcagttcgacttgcccggcctgccatgcccgcgatgtgccggccagcaatgatgctgggacccctactgcgcggccacgggatgcaacctcagccaaggcggcgcgtaactcctcgacggtgctttcgatgtaccaactgccgtcagtactagtctcagcggcatcggtggtagcgataagagcatcggtgaggtcgtcgacggcgcggtccagatcagcgatgtccggtagggctacaggagtcatggtgtgtcttccttctagggtgccttcactggtgaagggtccctagccccggccgatgtgcggttctgtgggaaaaatgcttcccattggtccgtcttagttaggaaacttggcctaagtgctgtcgagggtcgcgtgttcgtgaccggttcgaagacactgccgccttgccttcttgtcagtggcgtttccgagatggggtcagtgggcgatggctaggccgatgagggcgccgctgcacaggctgggtgccaggggaggaatcgggtggtgtggtgtcggaaccggtcgattagggcatatagggcgatcagggtgaggccggctatgacagtgacctgg

SEQ ID NO: 357 - DNA, 1602 bp, Propionibacterium acnes
gacgccttcggcgtcgggtgagcgcgtggataggcgccccttcggggcacctgtaagcctgtatcgctgcggtttacagccttggccacccgaaaggggcggcaaggggccaggaggggcattctgcgccgctgatggcatctcacatgtgagttattctctcaactatccttcaagtcaagcgtattagattatttatccagtactcttgacagtctgtctatcgggctatatatttataagcagaacgagagatcgggaaaggaatcaacgatgaagtacaccgcacacgtcaacatggtgaccaagccctacatcggacttcccactacccgaaccccctacaccctcgtcgacgccgactgggccacaacatggatgatcgacgaaacctacgaagcccactaccacggcaccagcgtggagatcagcatctacggcgaaggccccgactgctccgtactcaccaaccgcatctacaccgaccagcccaccgatgtgaccgctgcactcgccgactacggcttcaccatcgacaccaccaacacatccaaaaccatcctcacgctcacccgcacagccaccatctcccacctgctagccatcctcgatggcctaccccaagctgaggggactcactggctcaacactcaacccgacctccaccacatcaccctcgacgactccaccaccggctgggccaccaaccgcaccgacgacaccgacaccggcgtctgctacgacaccagcacccacaactggcagatctgctgacagcatgacgggcctgcccttgaggggaagttggactctgcacccatttcagccgggtacgttgccggctgggcgaaggaagcagacggcgccgcgattgaagctgccgccgagcacgtcgcgaagacctcccacgcgattgccgaggcgttgcagctcaccgcacagtgagccccacggggcgaccggctcaccccggtcgcccctcaccccccgacaggggaaccgttcccgccgcctgaatctccatacccctgatacgtactacgcggggtcgaggagtggactcccccaccctcgtgtagtacattgtactatagacgtcttacgaggtgacaccatgagtttttccatccgtttaaccgaccatgagcgccgcttagctgattcctacgcccacctacactcgcagtccctgagtgaggctttcaagcaagccctcttcgaccgcatcgccgacgagttcgatctgcaagtagcccgtgaggcactcaccgactacgccaacgacaactaccagtctcgtcccatcagcgagctatgggacgagtgtgacctatgacttggcagatcgaaaccactagccggttcgataaagaattcaaaaagctagaccgctacacccaaaaactcattcacggctggatcacgaaaaacatcgacaacaccgacgatccccgccgccacggcaagcccctcaccggtgatctttctggactgtggcgctaccggatcggtgattatcgcctcatatgcacactcaacgatgaccgcctcatcatccttgccctgtccatcggtcaccgccgcgacatctaccgataagcc

SEQ ID NO: 358 - DNA, 1452 bp, Propionibacterium acnes
cgctgatgaggctgccgagttggcgtggcggttcgtggggtggtgtcctcagctggtaggggcaccgaagaaggtgcgtggccagctccgtcagctggtcgctgccgagatccgccggaatccgggctggctggatgcgccagcgttggaggttgttgcccagcgggtacgtgctgaaggtgcgctgggggtccagcactgcgagattgtgcgagccgagctgcacggggtgatcgccgaccagaaggccgcccccgcccgccccgacgccctgcacgcgcgggagcccaagtggtgggacgacgtgtactacgaaggaaacacaaccgtgtggtacgactctgacgaaaccagtgacgacgacgaggcgtggaaccggtcgcaggtatgtcatgttgctgagcgtgacgacatggctggcgggattgctaccaacctgctggcctcccacgctgatgatccgatggcctggctgactcgccgtcaaaccatgctgatggctcgtttcccccacgcccagaacgaggtcatcgcgatgtgccacatcgtgcgcaccgccctggaggccgacatggccgccggaacccggtgggaggactgatgagggtctcccggcgcgccctcatggccgtggcccgtgccgacgctgccgcagcagaccatgccaccggccgatgggtggccacagccaacgccaccgtcgcccggctgaccggactgtgcgaacgcaccgtccaatacgcccgcgccaccctggtccacctgggcctgtgccgcgtcgtggccaccggccgctacctcaccgccgacgagcggcgcacggctgctcgcacccatggcggccgccagatgcgcgccgcctccacccgcgtcctcaccatgtcctgcgcaatcgtttgcgccctaccccgaaggggtcaccactacaggaaagttaagttcctagatggtcaccaacgcacgcgcaggcgcgtgcgaaggccagcaacaccagagaagaaacccctgtggctgcaaaaactcgcagccctcctcgaccagcacctgccctggctggtgagaaaccatcacatcggccgactgtgccacgccctcaccgccctgggcatcgacgaacactggcaacccgcagacctcgacgccctcctcgacgccatgaaccgcaggaaccgtcgcctcggcctcgacgtgccatgcgccgacgaccagcacaaccccttgggactgttcatccaccaggcccgagacaccctcacccacgacaacccccatgaacgccgcctggcccgcgaacaccaccgcgcccaactcatcgacgaccaactccgccgccgcgcagaaaccgccacctgcgcagcccgcctcgcagccgagcacgccgaccccgactaccagacccgccgtcgtgaacgcagggaaaccctgcgagccacactcagggccgcccagcag

SEQ ID NO: 359 - DNA, 1595 bp, Propionibacterium acnes
cggcgtcgggtgagcgcgtggataggcgccccttcggggcacctgtaagcctgtatcgctgcggtttacagccttggccacccaaaggggcagcaaggggcccggagggggcattctgcgccgctgatggcatctcacatgtgagttattctctcaactatcctttaagtcaagcgtattagattatttatccagtactcttgacagtctgtctatcgggctatatatttataagcagaacgagagatcgggaaaggaatcaacgatgaagtacaccgcacacgtcaacatggtgaccaagccctacatcggacttcccactacccgaaccccctacaccctcgtcgacgccgactgggccacaacatggatgatcgacgaaacctacgaagcccactaccacggcaccagcgtggagatcagcatctacggcgaaggccccgactgctccgtactcaccaaccgcatctacaccgaccagcccaccgatgtgaccgctgcactcgccgactacggcttcaccatcgaagccgccaatacatccaaaaccatcctcacgctcacccgcacagccaccatctcccacctgctagccatcctcgatggcctaccccaagctgaggggactcactggctcaacactcaacccgacctccaccacatcaccctcgacgactccaccaccggctgggccaccaaccgcaccgacgacaccgacaccggcgtctgctacgacaccagcacccacaactggcagatctgctgacagcatgacgggcctgcccttgaggggggggttggactctgcacccatttcagccgggtacgttgccggctgggcgaaggaagcagacggcgccgcgattgaagctgccgccgagcacgtcgcgaagacctcccacgcgattgccgaggcgttgcagctcaccgcacagtgagccccacggggcgaccggctcaccccggtcgcccctcaccccccgacaggggaaccgttcccgccgcctgaatctccatacccctgatacgtactacgcggggtcgaggagtggactcctccaccctcgtgtagtacattgtactatagacgtcttacgaggtgacatcatgagtttttccatccgtttaaccgaccatgagcgccgcttagctgattcctacgcccacctacactcgcagtccctgagtgaggctttcaagcaagccctcttcgaccgcatcgccgacgagttcgatctgcaagtagcccgtgaggcactcaccgactacgccaacgacaactaccagtctcgtcccatcagcgagctatgggacgagtgtgacctatgacttggcagatcgaaaccactagccggttcgataaagaattcaaaaagctagaccgctacacccaaaaactcattcacggctggatcacgaaaaacatcgacaacaccgacgatccccgccgccacggcaagcccctcaccggtgatctttctggactgtggcgctaccggatcggtgactatcgcctcatatgcacactcaacgatgaccgcctcatcatccttgccctgtccatcggtcaccgccgcgacatctaccgctaagcc

SEQ ID NO: 360 - DNA, 1388 bp, Propionibacterium acnes
gggttgccatcggaataccgtggaccatcccggcgcatacacccagacggtccaagatccaatccacgctcacccgcgacgccgctaacgatcctcatacaccgtagatgccgttctgagagccttccagacccgcacgtgggtttattgcaccgagacccaaatcccctcagaagcgatcctgaaaccgtctacgccccatttccgacggacgctggacaggctgggcggcttgtctcccgccgcagacatggccctggcatatgcggttgccgactggtgggatcagggattggatcacacggcagacggctggtccaaggcgggtgtgcaggtgcggtgagcggcagacgtgaccggtggggtgcactgtcatggccgggcatctgccgagccaccatgcgggccctggaccaggaggcagcccgctgcgaggactgggggaagacggcggcacggatgggccgtcgggatgcggcggccgaattcaccgagactgcggtgcagcatcgtggacagatgcaccacctcatgtcggcacaaaaagtgtgggtgtcgaccgacatggtgtcggctacactggacgccgcaggagacgtgccgagtttcgaggccgtcgacgtccctgccgccgggctcatgggtttggccagccccctgccgccggttaccctgcagcatccgctgtatctgcgcagcgacgagggtgtgacaaccttcactgatccggttctcgtcgacgcgctgggatggtggatggattctgggcgtgtgcacgtggtgatgtgcacacgcacaccccggctgcccaacccggtttatgcggtggcctccccactgacggtggtggagaaaatcacggtgcccaccggcatcgagttcgagaccatggagtccaggatcctgacccccggcggcgtgacaggcgtctcacggcagggcacacgcatgatgatccggttggcgtcatggctgggtgccgcgtgggtgctcatggcgactccgacggtgtcggagccgcaccctatggatggccggtggggaggcccagcaacggggcagacccggccgcgtgatcgggtgaccgtggtcgacatgcggcccatgaggcaggtgcacaccaccaccgaccccaccggcaggcggttgacgacccggcatgtcgtgcgaggacactggacacaccaaccctacggcccggcccgcagtctccgacgcctgcagtgggtcgccccattcatccgcggccccgaaggggctccgttcgtcggcaccgacaccgtcaccgtatggcgccgctagatacgcgggcgcggggggttgacgaacgatgcccccctctttgtgttgtgatcagtcgtgatcggcgggttttaggtcggggtagg

SEQ ID NO: 361 - DNA, 1578 bp, Propionibacterium acnes
tggataggcgccccttcggggcacctgtaagcctgtatcgctgcggtttacagccttggccacccaaaggggcagcaaggggcccggagggggcattctgcgccgctgatggcatctcacatgtgagttattctctcaactatcctttaagtcaagcgtattagattatttatccagtactcttgacagtctgtctatcgggctatatatttataagcagaacgagagatcgggaaaggaatcaacgatgaagtacaccgcacacgtcaacatggtgaccaagccctacatcggacttcccactacccgaaccccctacaccctcgtcgacgccgactgggccacaacatggatgatcgacgaaacctacgaagcccactaccacggcaccagcgtggagatcagcatctacggcgaaggccccgactgctccgtactcaccaaccgcatctacaccgaccagcccaccgatgtgaccgctgcactcgccgactacggcttcaccatcgaagccgccaatacatccaaaaccatcctcacgctcacccgcacagccaccatctcccacctgctagccatcctcgatggcctaccccaagctgaggggactcactggctcaacactcaacccgacctccaccacatcaccctcgacgactccaccaccggctgggccaccaaccgcaccgacgacaccgacaccggcgtctgctacgacaccagcacccacaactggcagatctgctgacagcatgacgggcctgcccttgagggggggggttggactctgcacccatttcagccgggtacgttgccggctgggcgaaggaagcagacggcgccgcgattgaagctgccgccgagcacgtcgcgaagacctcccacgcgattgccgaggcgttgcagctcaccgcacagtgagccccacggggcgaccggctcaccccggtcgcccctcaccccccgacaggggaaccgttcccgccgcctgaatctccatacccctgatacgtactacgcggggtcgaggagtggactcctccaccctcgtgtagtacattgtactatagacgtcttacgaggtgacatcatgagtttttccatccgtttaaccgaccatgagcgccgcttagctgattcctacgcccacctacactcgcagtccctgagtgaggctttcaagcaagccctcttcgaccgcatcgccgacgagttcgatctgcaagtagcccgtgaggcactcaccgactacgccaacgacaactaccagtctcgtcccatcagcgagctatgggacgagtgtgacctatgacttggcagatcgaaaccactagccggttcgataaagaattcaaaaagctagaccgctacacccaaaaactcattcacggctggatcacgaaaaacatcgacaacaccgacgatccccgccgccacggcaagcccctcaccggtgatctttctggactgtggcgctaccggatcggtgactatcgcctcatatgcacactcaacgatgaccgcctcatcatccttgccctgtccatcggtcaccgccgcgacatctaccgctaagcc

SEQ ID NO: 362 - DNA, 1665 bp, Propionibacterium acnes
ccccaatgcccccacaacgatcagcacacccacggcgatcatcaggtgggcagcactaactgatcccaacggaccaagatcaaacaagccctgcccgggagcgtcgagcagtccgtgggcgcgaagccatgctccgagattgccaatgatcttggggatcatcttgttcagtagggctatccctccgatgccgacaacgaggaagacgaggatttcttcgcctgcgttgtttcttcctgtgtttgcggtcatgctgccttctcggggtggatggccagccagctgatgaggttgtcggtgatctgccctgagatttggatcagttcgacttgcccggcctgccatgcccgcgatgtgccggccagcaatgatgctgggacccctactgcgcggccacgggatgcaacctcagccaaggcggcgcgtaactcctcgacggtgctttcgatgtaccaactgccgtcagtactagtctcagcggcatcggtggtagcgataagagcatcggtgaggtcgtcgacggcgcggtccagatcagcgatgtccggtagggctacaggagtcatggtgtgtcttccttctagggtgccttcactggtgaagggtccctagccccggccgatgtgcggttctgtgggaaaaatgcttcccattggtccgtcttagttaggaaacttggcctaagtgctgtcgagggtcgcgtgttcgtgaccggttcgaagacactgccgctttgccttcttgtcagtggcgtttccgagatggggtcagtgggcgatggctaggccgatgagggcgccgctgcacaggctgggtgcccaggggaggaatcgggtggtgtggtgtcggaaccggtcgatgagggcatatagggcgatcagggtgaggccggctatgaccgtggcgtggatcgtgtcgatgccggttgctgcggccggggctgcccacagtggtgtgatgcgcacgtcggagaagccgaagccgcctcgggagatgagccaggcgatcatccacgccgcggagatgacgacagtagcgatagcagcacgtatcgccgcagtctggttcgcgagagcgatcatggccacagccccgatccatccaacccagccggtccaggcgaggactgccggtatccatgtggtgatggcgtcgatgacggctacccatgccccgatggtggctagcagagcccaggccggccaggtgggtgctggggcccacgctacggcggcgatcatggttgtcgcagatgcagcacagacagcgatcatgcttcggagactgtaggtgtcgcggtaggcgattttgtcgggggtggcggtggccggttcgggcaggatgcgagtgagggcaggccatcctgcggtcgcaatggtcacgacggcggcgatccacacgatctgttgcatgggtctcatcatggcccaatatcgatgggtgtgggtggccgacatggggtcactcgtagaggggatcgaggggtgtgcgggcgagcatggcttcctgtgtgccgagcatgagggtgccagaatcctcgccggctgattcccagtcgacgatgatctgcccgctgtcgacgctggattcggtgatggtcacccattctccgtcgatattgatgagcaccccagcggccagctctgtggcagcaaccgggtgagg

SEQ ID NO: 363 - DNA, 1497 bp, Propionibacterium acnes
gataccgcaaggctgtgtgggatcagctgtgccgctcccccgacatggcagacagcaccctgcggactgactgacactgtggcgccgcggaggtctcccgcggcgtccgctggggcgagtgcgtgtctgtcatctcatcttttcccgtcacatttccccttgtcagagcggtttttgcaaagtgacaacgtcaggggtcttgacgacaacatcctcgacaacatcgtggcggtggtctgtgtctcgtcagttcaacgcaccggggaaagaggcaccgctgatgttcaccaccacaaacaccctcaacgatgagtgggaccagattcgcgccatcgagatcgattggcatgactgccctgaactgatgcactgcatcgacgttgatgatgtgttggccgtcattcctgccgcccccgacgccatcttgggctacctcattgcccgggctcagggcggtgacgagttggccacccgcactatcatccaagcgttcacaggcaagcttattttgatggccacggccaccaaggtgcgccgtactaatgacggcttcaatgatctgttggcggggttgtgggagacgatcatcacgtacccgttggatcgtcgccctgacaagatcgctgcgaacctcaccctcgacacgttgcaccgggttacccggttctggcgtgctgattcccccgatgaggaagaggctcacggtctggtgcccttccctgacactctcatcgccccagagcccgatgaggacgtcacagctagccaggccatcgccttggcggtggaccgcaactggattaccgaggacctagcccgcctcatgagccatatttactgtgacggtatgactggagctgatgcgggtcgtctgcatggctgcgctccagctacggtgcgatctcgatgccgtgatggtcgggccgtgttgcagcgcaacgccgagacgatcctggccgtctgctgatcctctcttgctcatgcctgccgccaccctacccctacctgctagaaacatagccatgtctccagcaacgcatctagcatatcgtctagcaattgatctagctatgtatatagctgatgatctagctatcatatagctgtgtctccagcccaaatgacagcccaatggcatgcttgccacaggaaggtgcgtcagcctcccgaaatactggaaggagctttaccgtgcaggacatgacctcgaccagaccgattgaccgatccccgttcgaccgcaccatcgcggtatggaaccacaaaggcggcaccttcaagacgtccgtcgtggcgaacctgggatacctgttcgccgccggtggcaacaaggtgctgctggtcgacatggacccccaagccaatctcgacatcgacttcggtacccccgccaatgagcgtgaacgaggcataggattagccgaggcgctacgtgaggggacggcccttcccccaccacagcatctcagcgaaaacctccacctggtcagtggcggc

SEQ ID NO: 364 - DNA, 1374 bp, Propionibacterium acnes
gacgggttcctgccaatcgatggttgacaagtcgtcggcggcttgttggtaggtaaggtggatcattggctgtttgagtgcagcgccatgccagtgtctctggccggcgtcgatccagatggattcgcccttggtcaggtgctggggtgcttgtccttcaatatggaccagggcaacgccgcccgtgacgtagaggccctgtcccttggggtgtgtgcctcagcggcaaacgtgacggcgtgggcggcacgcccggcgtcttccgtggcacgatcggccggatccatggcggcgcgcagctgctgttctgcagccaggcgtccaggtcacggcgggcagcatcgacacccagggcagcctcgacggcttcagggctacgacgctggccgggctggttgaccgcagaccactggtgccgggcgtcgtccagatcatggccggcggcgtcgatgagggcggtggtggcttcggcgcagcatcgcctgatccactccgaacgtgacaggccagctgtctcggcggcactgtcaatgcgcgccaggagagatttcatgggcgctcatctgtagcctccagataggcgttgatgtagcgcagagcctgatccgtcatgtcgatggcggctgcctcggcagacgacacaacgggctgtggatgataagaccacccaacatagacggcgaacatcaatttctcgacagctttcatgaggtccccggcggcaaccgcatccgcctcatcatccgaggagaaccacttcaggtctgaacggctgtacatagcccctaggtcctgatgtgggtcgaggtccttggaatgatggaagttcctacacacccatcgccaaagacctcaacatggacaacgctaccttcaccactccctcatctgtgaagagccagtttatgcacggtgttgaaagaggcgtcggtctacgacgaatgcgggttaatggtcttgcggtgtggggcgctgggcgatggcatcgagaacgcgtgagtgggtggcgatccattcggccgcgtcggggttgatgttgcgggcgacggtgtcgatcgctgttacgtagtgggcaagcctgcgaatctcagcttgttggtcagggtgagcgctgatgaggggctcttgatgggaggcgcggttacggacgtggcggatgagctccacgttttcctcgaagtcgcgtcggctacgccccgggtagtgaggcatacctccgttacgtaagtcagtgagagctttccatacggttgcttccaggcgcggggtgagcagaaagcgccagttgtccagtgacagactcgccacgatctgatcaggggtcgcatcgagcctcgcgcgccgcagtcgcttctcggccctgtcgacgttacg

SEQ ID NO: 365 - DNA, 1569 bp, Propionibacterium acnes
gcccatccggtccaggcgaggactgccggtatccatgtggtgatggcgtcgatgacggctacccatgccccgatggtggctagcagagcccaggccggccaggtgggtgctggggcccacgctacggcggcgatcatggttgtcgcagatgcagcacagacagcgatcatgcttcggagactgtaggtgtcgcggtaggcgattttgtcggggctggcggtagctggttctggcaggatgtgggtgagggcaggccaccctgcggccgcgatagccatcacggcgaccacccacacaatctgttgcatgggtctcatcatggcccatcaacgccgaaaatgggtggccgacatgggttcactcgtcaagaggtgtacgggcggccgtggcttctcctgcgccgagcatgagggtgccagaatcctcgccagccgattcccagtcgacgatgacctggtcgccgtcaacgctggattcggcgatggtcacccattgcccgtccatgttgatgagcatcccggcggccagctctgtggcggcaaccgggtgggctgggctgtagaggaggtcgatgtcgcgggcagggtcgtcgggttcttcggttacctcgggtggggtcgatctggctgtctcggtgtcgtcggccaggtcggctcccaggatgcgttcccattcggggctggttttcttgcccgctgaggccatcgtctcgtcgatctgttcgtcagtgggccacacaaatttctttttggtccaggtcgtggtgtcgggtcgcagctgatccagcagttccaggtcttgcggggagtgggccttgcgggggtcgggggtgtagaagaattggacttccttgggggctgattcgccggataggtaggtgccgcggccgcgtttgccgaacgggattcccacgccgacgtgttcggagccgaacatcatgcgggctccgtcagcagacaggggtccggtggcggcacgcccggagaagttgtctcggatttcgccgcccaggaactcggcgtcggggcgttgggtccccagatcgacgtggatacggcaggcagctgccatgcgcagcagggagccgatccagccgaaaacggggcattctccgggcatcccagagaccttgatcgttgaccaccagtttttcgcgttgccgtagaactggcggtactcgtcgatgaggaccagcacgcgggtgaagtcggtctcgcgggccccttcttcttcgatgcggcggtagcggtcctccatgagagaccacagccagtggatgagggcgacctggtcggggacggtagtggcgaccatctcgatgttgggccactcccgcaggcccaggtactcgatgcgtttagggtcgatgacgaagacgcgccagttgcggcgggcaccctcgacggcgtcgccgatcatggacaccgtttttccggtacgggtgcggccggccttgagctggtgggccatgacaccggagatgtcccagaaacaggtgttgccgtcctcgtcgacggcctgggggattttctcccagtctggggagtctgggcccggaagggccacggg

SEQ ID NO: 366 - DNA, 1390 bp, Propionibacterium acnes
tgcccagcgtttctcggcgatgtcgatcatgtcttggatggttttgacccatcctcggatgggatcgactttggtcagtttgatcccttcgaggaactcgatgggctgggtgatgggcccatctggtccggcttcggtgtcccagccttcgtcgatggctagtttcagttcggcggtatcgacccatgtttcgtgggtggtgccgggcacgttgggccaaaaccatcctgctcgtcctttggtgcgtttgaccggtagtaggccgatgtcgtcccaccaggatggcacggtgaagcggatgtggtagcgggccgggtgccaggggttgttggtgaacaggtcgcgggcttcggtggcgctgagcagagtggcgggtgcggcaccgatctctccggtcactgatccggcatacatgaatcggccgtcgatgtacacgaagttagggatagggccggcaggcacggtggggcgccagcccttttcgcggtcctcggggttgccgtcgtcgacgcatagttcgtagcggtgctgaggggaggtgtgttggatgagtgcgcccagttcggggtccatcggctccatgcgataggactcgggggtccgtagcttccagaggttgattccttctgctccggggcggtccatgagggcccagtcgcggtcgattctggtggcgatgatgtgggttaattcgcgccatgcccagcgggcctggattggggtgagggtctggccagggaaccattcatcagcgaccagaatgtcgaggttgcggtcggtttctttgtgggtgaaccggcctcgggcgggccgcccggacagcatgaacaggccccgcacgtgccagtcctggttgaactcgcgggtgtgagcgggggtgtcaggcagcagccaggattgaggctggtcggggatgttaccgcagacgatcaggcgtcgggcgttgtggtgtagcgcggttgttagcaggtctgacagggtcgcgtgcttggtgcgtcgtccccccagcactggcaggatctcgtttccggccgcgtcgactccccgggcggtgtcgatgtctagccacactgtttcggggtcggggggccgatgtggggcgggacggcgctgctcctggtcgtctctcatggtttcctcctttgggccagggagcggccggcgtcgagggcgttcatgcgctcgcgttgttcttcgcgtagttggtagacccggcctcgtgacactcctgctgcctcggcgatggtggtggccggcaggtggccgatggcggcagcgtcggcaaggacgtcacgccaggccaggtcaatggttcccagctgggctagagcttcgtcgcggcggcgggtggcatcagccactacggaggcccaccctgtggggtggatgg

SEQ ID NO: 367 - DNA, 1289 bp, Propionibacterium acnes
cttcgacgctctggccgagtgggccgagagcgatgaggcgacccacaccccgcaaaccagccccgtgttccggggcaaggacgccgcgcgcgccagccgcgcattcctcggccgaggacggcccaccctcggctcagaccacgccaccggcgagggccggtcgccccgccgtcaggtacggctcgacgcacgcaccaacgcgcgactcgacgcctacgcagccgcaaccggcaccagcgcctcccagatcatccgcgacgccctcgctgactacctgcccgcctgatcccaccccaatccactcgggcgcctgtcagtgccccccttctgggtggtggtccagggcgtcaccgccccggaccagttgggtagtcatctcagttgaaataagcgattagtgatacgcccctcatgctttccggtgctgtcatgagcgtctgacaacagcgacacctcggggcagccgacggacagtcctctggctgccgctctgatcccatgcccacggcacgaaggtgtcggacagctcggtctcgtcatgtgcccaaatagcgtcgtgggcctgtcgccaagcttctcgggagccccacacgggcacgaccgggccacaccggtgtcctggtctccagtgtcgcgacactgtcgatttcggtacgtgcaatgcggcggcggtttgacggatcgacatcccagactcccgcgcgtcccagatcgccatgtggagagtatttgcctccagtgcggccgccacacttgcacgctctcgcgcacgctcgaatgcccgcctagtgctctcaaatgtcgtcacgacgcctccccctgaaaatactcagggtgtcccacggtgggacaccctgagtatttcataccccaactcgcctcaccacacgtcgacctcgacaccgatcaagcgacccgtatcagcgacattgccgtaacgctgccccgcctggtcctccagccacgacaacgcatcccgaaacagcccgacgtcttccaaagctaaaccacagtcgtagccgcccttgtcccccaaccgcacaatctggcgctcccggtggcctccctcgtcgacctcgatccacagtttcgcgtgcatccgctggcctcggccctctgacaggatctcggtgagcaggtcggacgcctgccctcgcgcatcctcgttactgcgggggaattggagtatgtgggaggaacggtggtggggcaggtttgtgacctcgtgacgcagcaggttgcgcttgtgcatctgccgttcgagacgctcgggctgacctgttgacggg

SEQ ID NO: 368 - DNA, 1226 bp, Propionibacterium acnes
ccgagccagtaaccaggaacgaggacgataggccgatgctggtcaggtcgcgatgttgaagtcatggagacatagttgcacagtgcgcggacaagggagtggcactatttctggcatgaatttagatctgggtgtccggtgaggcgatcagaacgcctccatgtactgtccgagtgtctacgatgcagcggacacagtcgagcagctggctcacaagtttccaggtgtccttctgcccctatgagggaagtcggctgctctcgcaacctttgagggctgctctggggtcggaaccagttacagatcgttcaagttccgggaactaccgccggtcacgctgattgattcccgggcgatctcgcttctgacgacagtggtcggtaaccgagaggcgtcctactctgaccccgctgctgcggtgagtaaatcacgggcgtcccggatccggccacccgtccaagtgccagccagcttgatcggctaggcatcgtcaaggagcgacgatgaggtgatgatgcgatgtgagcgcaccgcgaagtgaggtataaagaagccttcccgggcgcatgcgtcgcccaggaaggccaggttggcccctggacggctgaatggttgggcggatcaggctgtagcggagacgtgcagtacctcgtaggcgatggcgttggttggggtctggtctgcatcgtggctactgagttcgacgaggatgacggtccaggtggtgatgtcgacggcggtgacgcgggcgatggtggaatcagtggatgctgcaaggaagtcggcggttatgtcttcgatgcagtgggacggagcagtgctggtgggcaggggcacggtcttgacggtcaggcttcgggcagcagagtaatcggcggttccgttaacaagctggtggacggtccagtcctggatcgggtgccggccgaagtcgcgtacgatagccgagtaaccaagttcgccccagcagaactggcgcatcccctctatgtcgcgccagacgtagaagggcgcgtaggagttctggggtgcgcctttgaccttttcttggatgaggtaggccttgaactccagtccatggtagccgtccatgaggtgtccagtctggatgacgcggtcgcggatgatctgcatgtcatagtcggtgggcagggtgatctgatattgcatggcgtacatcagcggttctccttggtttcgtgggagtaggtcgtgggggtgacggg

SEQ ID NO: 369 - DNA, 1269 bp, Propionibacterium acnes
tagaccctctgctgagggcttcatcaagatccatcacgaccttattagtgtcggcgtgtcgggtaacgcgatggcgttgttcgtcgcgttacgtaaccagcccggctgtgatcagtggacccgtcactcgtacctgcggctagcccaatggtgcggctgggatgggctgtcggaggcggcgggctgtaagcgggtgcagcgggccgctgctgagctcgctagcggtggttggctggaatcgcgggtcggccatgatcgtcgcaccgctaagacgctggtgtggcatcggttgaccagccccgacaccgaccgctgggagcaattgccgcggattgtgtgggcgaggatctgccagatcgccggggagacgtcgggagagtgggtgaggcattggctggtgtggcggatgctggccggtcgtactggtgtggctcaggcccctacgtccatcgtggcccggttcctgggctgttcttcgcgccaggtctctcatatccgtggggctctcgttgatgccggtctgctcggctgtgacgaggtctcgggggcggcgagccgggtgtggttcccctcgatggccgaggagtgtgcagcggatcgtgaggtggtcgatggggccgtcgtcgatgctgaggtgggctctggtgaaggtgtcgaggagggcggggaacccctgtcgattttgtccacccacccctgtcgattttgtccacccacccctgtcgattttgtccgccaagtattagacaaaccattagacagtgaattagaccctgggtcgcgtcagcgtgtgaactcaccaacgcgcgcgcgcgcggcggccgagccgccgaagccaaagaaacccataccaccaacgcctgaaccagcagcccccgcttcagacagtcctgtgtcagcgcacgctgatgaggctgccgagttggcgtggcagttcgtggggtggtgtcctcagctggtaggggcaccgaagaaggtgcgtggccagctccgccagatggtcgctgccgagatccgccggaatccgggctggctggatgcgccagcgttggaggttgttgcccagcgggtacgtgctgaaggtgcgctgggggtccagcactgtgagattgtgcgagccgagctgcacggggtgatcgccgaccagaaggccgcccccgcccgccccgacgccctgcacgcgcgggagcccaagtggtgggacgacgtgtactacgaaggaaacacaaccgtgtggtacgactctgacgaaaccagtgacgacgacga

SEQ ID NO: 370 - DNA, 1195 bp, Propionibacterium acnes
gaacgccaccgtgttgcctttctgatcctgagtgtcggcatgcaaatcgaggtaggccagcgactgcaacggggagcctgtgaccacagccaacgggatgccggtggtacggcccaaccggtactcaaccaccgggatagatgcggcgaacgcggaggcgtgagtcagctgacggtaggcgttaagcgaggaggagaaccggccaccgggccgggcagcccacagcaagtcctcctgacggcccacgggacgcacccacgtgaagtcaccgaacaccggatcattgacgaacgctcctgccagctcctcggtggtctcaaagtcaggagacgagacagtgacggtgataagagcctggatctcgacctcacgctcatcggcggccagctcggcgttgtagtcgacgagcacctgagcggaatgctcgatagacatgagggtcgaagcctgggtcatctcaccgccctcgacgttgtcgagctgatcgaccgtttgacggatagcccgctgatttttctgcatcgcagcgtgacgggtccgggccactccccggatcgccacgtcgaccggcacgccagtgtcgtcgatacggcccaaaaactcgtaggcaggccacgtcatcgtgcggggcaccttacccagcacgatatgggactggtagacggtctcgccggtgtcggcaccgattttgaggacgcgacgattccacgcctgagccgtccgggacatgtgggagactcgcttgtcatcctcgctggccagcaggtcggaggtcgcggcctcatcgatgaccaactcccccagcgcggcacgtccaacctcatccatgagggcgattccctcgccaggggcatcatcacgcaaccgggtcgggtggcctgacaggtgctgccgaagccagatctgttcatcaacggtgaccgggcggggttggaacgctgccggcagtttcgcaccgaattccttagcctgacggagggcccactcccgtgcgacacggccaggagcggtggtcatgagtccggcggcttcggtgattttgttgagggcggcggtccaggcggtgtgggtgcgtattttctggtcttggttgagtttgatcgataggaaccacacgcgccggcctagggattcggtttcaggctggtcgagggtggcgtcgatttcgtcggcccacacggggtgttcgctcagg

SEQ ID NO: 371 - DNA, 1199 bp, Propionibacterium acnes
acccttccagcccagcaccacccactacaccgacacgatccacgaagctgaaaccgaacctcccatccccgtccgaaacatcaacgaactcatcaaccccaccaaccatgcatgaacgcacgatcgcctaccggccagccttcctgcgcgacgtgaagcggctcaaaaacaagcactacaacatgaacacacactcaaatgggcggtaaggtcacgaagtcgacgtggctgcctcacggatggcttcggcgagctcttggggtcgactccacatgggccagtggccggttggcagatccatcgcggtgaagttggtcaggtgcgcgacggcgctgaacatcggattgcctgctgcggccagctcgaggacctggacgctgggaatggagcagcagatcaacgtggttagtacatcatggcgagcgctattggacagcgcgacccgtgcccgggccacttgcgcgggttcaggaaccgcccgtgcccggaaccggtcaaggtgctcgttgctgaggccctctaaactggcctgcttgccgagagtatcgaagtcaggaagtggcagctcagctgtttcctcaggtagatctggtgcgaaggcacctccatcgctcatgggaccggagtccacccagacgatccgatggaccaactctgggtgcctgtctacaactaggctcaccggcccgttcgcgccactgtgtcccaccaggaccgcatcgccgcccatctcgtccaggatggctgagatggcgtcagcttggtcgtcgagcgtgcgcgtagtgcgctgggtgtcctccggatcgagacctggcagcgtcagccccacggctcgactgccagcagtgttcaataactcgactacctcgtcccaagcccaggctccgagccagtaaccaggaacgaggacgataggccgatgctggtcaggtcgcgatgttgaagtcatggagacatagttgcacagtgcgcggacaagggagtggcactatttctggcatgaatttagatctgggtgtccggtgaggcgatcagaacgcctccatgtactgtccgagtgtctaggatgcagcggacacagtcgagcagctggctcacaagtttccaggtgtccttctgcccctatgagggaagtcggctgctctcgcaacctttgagggctgctctggggtcggaaccagttacagatcgttcaagtt

SEQ ID NO: 372 - DNA, 813 bp, Propionibacterium acnes
cgattttgtccacccacccctgtcgattttgtccgccaagtattagacaaaccattagacagtgaattagaccctgggtcgcgtcagcgtgttagctcaccaacgcgcgcgcgcgcggcggccgagccgccgaagccaaagaaacccataccaccaacgcctgaaccagcagcccccgcttcagacagtcctgtgtcagcgcacgctgatgaggctgccgagttggcgtggcagttcgtggggtggtgtcctcagctggtaggggcaccgaagaaggtgcgtggccagctccgtcagctggtcgctgccgagatccgccggaatccgggctggctggatgcgccagcgttggaggttgttgcccagcgggtacgtgctgaaggtgcgctgggggtccagcactgcgagattgtgcgagccgagctgcacggggtgatcgccgaccagaaggccgcccccgcccgccccgacgccctgcacgcgcgggagcccaagtggtgggacgacgtgtactacgaaggaaacacaaccgtgtggacgtacgactctgacgaaaccagtgacgacgacgaggcgtggaaccggtcgcaggtatgtcatgttgctgagcgtgacgacatggctggcgggattgctaccaacctgctggcctcccacgctgatgatccgatggcctggctgactcgccgtcaaaccatgctgatggctcgtttcccccacgcccagaacgaggtcaccgcgatgtgccaaatcgtgcgcaccgccctggaggccgacctggccgccggaacccggtgggaggaccgatgaggg

SEQ ID NO: 373 - DNA, 1204 bp, Propionibacterium acnes
ccggagtatctggacaaggccgtgctcactgcgttgtatcccgatgggttgcccttcgacgaggacaccgaggagccgggcgagaatgccgggcaggaggagcttgcgatgactggatgagcccgaacatggttgaaggccgccccgccaggcgaccttcaatcaatggtttcggttgtcagctgcagccacccttgccaggtgctgtggttcttctccagaggaggagggaccgccatgaagacccagaagatctagaagatccaaaagaaccggtttcggctgttgcttcggtcttcatggtagctgatagcccgcgtcgttggaagtgcgacgacgccgatcctcatcggtatcgcaccctgttccagggtcgagaatgtgaaggattaacaaccatgacaagtcatgagacgccctccctgagggcgtcatgaccgctttaattcaagctctgccgacagctgaactgtctgctggacctggtgctagcagtccagctagaccctctgctgagggcttcatcaagattcatcacgaccttattagtgcgggcgtgtcgggtaacgcgatggcgttgttcgtcgcgttacgtaaccagcccggctgtgatcagtggacccgtcactcgtacctgcggctagcccaatggtgcggctgggatgggctgtcggaggcggcgggctgtaagcgggtgcagcgggccgctgctgagctcgctagcggtggttggctggaatcgcgggtcggccatgatcgtcgcaccgctaagacgctggtgtggcatcggttgaccagccccgacaccgaccgctgggagcaattgccgcggattgtgtgggcgaggatctgccagatcgccggggagacgtcgggagagtgggggaggcattggctggtgtggcggatgctggccggtcgtactggtgtggctcaggcccctatgtccatcgtggctcggttcctgggctgttcttcgcgccaggtctctcatatccgtggggctctcgttgatgccggtctgctcggctgtgacgaggtctcgggggcggcgagccgggtgtggttcccctcgatggccgaggagtgtgcagcggatcgtgaggtggttgatggggccgtcgtcgatgctggggtgggctctggtgaaggtgtcgaggagggcggggaacccctgtcgattttgtccacccacccctgtcga

SEQ ID NO: 374 - DNA, 1288 bp, Propionibacterium acnes
ccgaactcaccgaagaccaccgcaaccgcctcgccagcctcgtcgaggctcttccccgcgtgtcagtcgccgcggtaacaaccagccccaccagcccagacgaatggtccctcaccctgacaggtgacccactagccgccgacgtggctcccctcggctggcacatccacccccaaaccctctcccccgacctgtacaaccgcatggttgaactactcgccaactccgccgccgcagactacgaacccgccagctggtggaaccacgacgccaacgacgagcccaccaccgaccccaccaacgaggaagaatctaccccgagcaggcgagcccgcccgaatatccgcctgaccaccctgaccggcggcatcgacctatccagcgtcgacatcgacgacatcatcgacgaagccaaccaggccctcgacaacaccgaccaggccaccaaccaggttcgtgtcgacaccgaccaacccggcaccgacacccccttccccatcgacgacatcgacccgctgagctccgaccatccggtcctatccatcatcggccaccccgacatcacaggtgccactggaaccgttgggcgctccccgtggcgctgccaacagttggccctctacatcgctgagcatccgggagcatcgggggcgactatcgccgatgatttggggctatcagcgtcgacggtgcgctcgattgctacacacctgcgacactggttgggagccgatgatgccggggtggcttacatgccggcggcgacgcgcggctaccggctcgatgagcggatcgtcacagatgtggacctgatcgacgctgctgtggccggggcaggcattaacaccgctgagacggccacactggtggccattttgaagctgggccgcggacgggtcttcgctggggttcctgactcggaacttcgccagttcagggcgtcgatgtaccacgtggaggcccgcatcgtcgatgctgccctccaagtgacagaccgggccctggaagccggggacctggggctggcccggtgggcgttgacccaagggctactggtgtctcccgatcatgaggacctggtcgccggttgtctgcgcaccgagtaccaggccggcaacatggacaaggtcgccgagctggtcgatcacctgtcggctaccgcacgccgactgggcgtcgacctcaacgaggacaccacccggatcatcgatacggtcacccacaccgacaggagagcgtcatgatctcccctgcactcatctccgtcaggaaggttcctatgcaccat

SEQ ID NO: 375 - DNA, 1239 bp, Propionibacterium acnes
aaaagaagaaacccaccaaccacgaaccatccgcaatatcgccggcgtaatccgacaacccctcatcacagtcaccaaggtcgtcgcgagcatccgagacgtcatcgtaagggccacccttgagcacctcgatgtacttgtcgtggcacttcgcatcaataatccggccatagttgagctgctgatgaaccggcgccacgaacgagtccacaatgatcgccgacagcttcggatccttcgagtctcccgtcgaggtcatgtcatcaggaatctcgacctcaccagcggtcgccgtcgcaggatcaaccgaactagtaatcatccgagacagcgccacaccgaactgctgggtgcgagccaacggagtagccaacgtcgtcgtatcgcctgcgaacttcgccaccggggccgccaagaaacccaacgccagcgccgcagcaatcgccgcacgcgcacccgtagcccacgccccagccgtacgtcccctcatcatcttgacgaccacgcccacaccggcgcacgtcgtcagcaacgtcaacaccgttccaccccagctgtccgctcccagcggggccaaaaccttgtcgtggatatcgttctgcaaccccaccagcgggccggtaatccacccgacccagctcatcgccacggtccagtccaacaaccggcacagcaacgcaatgaccatcaggtacgtgttccaacacataccaataatggaggcccacatagccttcaacggggccgtaacgccaccatcgtccatcgacatctggtactgaaacaagtgaataccgttggagtcagtcacattgaaaccgtcacccatccagcccagccccgggcccgacgccatagcaggcacactgctcagcgccaccaccaaaaccagcgtggtgacgatgatacggaaccaccgctccccggccccggggcggcgtggatgacggctcacgctgtctcccggtcgtgctcgggcgggttggagctggcggcttcgcggtggggagcgtaggcaggtctcagtagtcgaatttcaccgacgttgccgtgctgatcggcgtacaggccacaaccggggcctccggggttgagggcaatcttgaccaggtcagcgaactcttcaggggacgttttagggtccacgcccaggaactcgacacctttctgggcgaggttgatgttgtcgcacagcaacacgatgcgatgctgaatgaggttgcggacggtctcgttggg

SEQ ID NO: 376 - DNA, 1232 bp, Propionibacterium acnes
  modified_base (28)..(28): a, c, t, g, unknown or other
gcatcgatatatctatgtatctgtctgnggttttttagagggcccactcccgtcgccccgggccgctcagcgataccgcaaggctgtgtgggatcagctgtgccgctctcccgacatggcagacagcaccctgcggactgactgacactgtggcgccgcggaggtctcccgcggcgtccgctggggcgagtgcgtgtctgtcatctcatcttttatcgtcatgtttccccttgtcagaggggtctttgcaaagtgacaacgtcaggggtcttgacgacaacatcctcgacaacatcgtggcggtggtctgtgtcttgtcagttcaacgcaccggggaaagaggcaccgctgatgttcaccaccacaaacaccctcaacgatgaatgggaccagattcgcgccatcgagatcgattggcatgactgccctgaactgatgcactgcatcgacgttgatgatgtgttggccgtcattcctgccgcccccgacgccatcttgggctacctcattgcccgggctcagggcggtgacgagttggccacccgcactatcatccaagcgttcacaggcaagcttattttgatggccacggccaccaaggtgcgccgtactaatgacggcttcaatgatctgttggcgggtctgtgggagacgatcatcacttacccgttggatcgtcgccctgacaagatcgctgcgaacctcatcctcgacacgttgcaccgggttacccggttttggcgtgctgattcccccgatgaggaagaggctcacggtctggtgcccttccctgacactctcatcgccccagagcccgatgaggacgtcacagctagccaggccatcgccttggcggtggaccgcaactggattaccgaggacctagcccgcctcatgagccatatttactgtgacggtatgactggagctgatgcgggtcgtctgcatggctgcgctccagctacggtgcggtctcgatgccgtgatggtcgggccgtgttgcagcgcaacgccgagacgatcctggccgtctgctgatccctctcttgctcatgcctgccgccaccctacccctacctgctagaaacatagccatgtctccagcaacgcatctagcatatcttctagcaatttatctagctatgtatatagctgatgatctagctatcatatagctgtgtctccagcccaaaatgacagcccaatggcatgcttgccacaggaaggtgcgt

SEQ ID NO: 377 - DNA, 1200 bp, Propionibacterium acnes
ccggagtatctggacaaggccgtgctcactgcgttgtatcccgatgggttgcccttcgacgaggacaccgaggagccgggcgagaatgccgggcaggaggagcttgcgatgactggatgagcccgaacatggttgaaggccgccccgccaggcgaccttcaatcaatggtttcggttgtcagctgcagccacccttgccaggtgctgtggttcttctccagaggaggagggaccgccatgaagacccagaagatctagaagatccaaaagaaccggtttcggctgttgcttcggtcttcatggtagctgatagcccgcgtcgttggaagtgcgacgacgccgatcctcatcggtatcgcaccctgaaacagggtgttgaacatgaaggattaacaaccatgacaagtcatgaggcgtcctcccggagggcgtcatgaccgctttaattcaagctctgccgacagctgaactgtctgctggacctggtgctagcagtccagctagaccctctgctgagggcttcatcaagattcatcacgaccttattagtgcgggcgtgtcggggaacgcgatggcgttgttcgtcgcgttacgtaaccagcccggctgtgatcagtggacccgtcactcgtacctgcggctagcccaatggtgcggctgggatgggctgtcggaggcggcgggctgtaagcgggtgcagcgggccgctgctgagctcgctagcggtggttggctggaatcgcgggtcggccatgatcgtcgcaccgctaagacgctggtgtggcatcggttgaccagccccgacaccgaccgctgggagcaattgccgcggattgtgtgggcgaggatctgccagatcgccggggagacgtcgggagagtgggtgaggcattggctggtgtggcggatgctggccggtcgtactggtgtggctcaggcccctacgtccatcgtggcccggttcctgggctgttcttcgcgccaggtctctcatatccgtggggctctcgttgatgccggtctgctcggctgtgacgaggtgtcgggggcggcgagccgggtgtggttcccctcgatggccgaggagtgtgcagcggatcgtgaggtggtcgatggggccgtcgtcggtgctggggtgggctctggtgaaggtgtcgaggagggcggggaacccctgtcgattttgtccacccacccctg

SEQ ID NO: 378 - DNA, 1271 bp, Propionibacterium acnes
gttgagggcgtgggatcagggtgaaggcagccaaactggccgggatgaggatgacggccgcgccgacacttcggagcgaggtcatgtgacgatccttcggtagctcgacgggttgccgtagatcttttccacgttgatgccactatgtgggttgtcggcgctaaccatttggcctccaccgatgtagacggccacgtggtgggcagggcttccccagaggatgaggtcgccgactttgagctggtcacgggccacggcagtgccgactttctgctggtcggcggcggtgcggggaaggctaatgccgatacgccggtacagcgccgaggtcaggcctgagcagtcgtagccgccatcggctttgccgttgccaccccacacgtaggcgtaggagttgttgtcggcgatcgatttggcccatgccacggcttcggccaggttcttcgacacaccggtctcgttagcggccccggtggcacagttgtttgacaggttccctgtagtagtggatcccactatttgtttggccatggtttcccatttggcgtaggcatcgggcagggctgagccttgcactgcctgagctgcctgcgtcagcggcatcttctgccagtcagcgatgtcgactaaaccgggaatgtggaatccagggccgccggccgatccggggccagcgtaggtgatggtgtggcctttcaagaacgcttcggtggcgtaggcatcattgttgatctgatccagagtcccgtaccagcccggcaggatgcgctgctgaaaggggccagcgtcgccgtcaccgttaggtttcgtggaggtggggtcggctccgagatctgattcttgtttggcggtcatgatagcgatgaccgctgcctgggtaggcagtttgtcacgctggaccacagtgacgatggtggtcacgagctgcttctgtctggcggtgaggcctccggcgccgaccccgccgccggtgacagttcccatgcaggcatccccgccagcgcctccaccagagttatcgtcgagggccccagagcctactgacagcagcggcacaatgatcacggtcgctggcaagaccgccaggcccgccagcatcagaactgctgcactcaccacggcgatcacgtgagatgctttcaacgctgcccacctctcgctggtttgagggggcgacgcctgctggtacgcacaggcttggttgatccagtccgccgttgattggcaggcctgggtttgatcggcttgctgggacccggtttgggctccgg

SEQ ID NO: 379 - DNA, 1100 bp, Propionibacterium acnes
aggcgagccagacgggcaataagcgcgtagagggctcggccaaacaccttgtgcgggggcagctgccgaaacaaatgttctgacagcatctcctcggcgttaggaagagcgatgccacaagtgccaatgatgaggatgtcggcactcaggtcggcgggaggaaggtccgggtcaaagatggccgaagctagggaggccgagttctcgatgtcagcgaacacggcaatcctgtcagcgatcgcggtggcctcgggaaggtcgcactcctcggccaggtggcgggccaaacgcccacacgaggtgatctggtggtcacgcatgtaggccggtttgaggaccttggccagcgtggtcccggccacaccgatggtctccaagttaagcaaggtcagcaagaacgactgggcgacctgcccggccatctccgggggaaggatgcgcagcgggtccagcgacagcttggggtgggccgtgtcgacgatctggcgtctaaccccgtcgatagagttgacaaaggttacccactcccgctcatcggagttgtcggtggcaataatgcgcccgccccgggccgcgatggctgcgcacagccgcttctcggccatcgtcttgcccgcgcccatcttgccgatgaacgccaccgtgttgcctttctgatcctgagtgtcggcatgcaaatcgaggtaggccagcgactgcaacggggagcctgtgaccacagccaacgggatgccggtggtacggcccaaccggtactcaaccaccgggatagatgcggcgaacgcggaggcgtgagtcagctgacggtaggcgttaagcgaggaggagaaccggccaccgggccgggcagcccacagcaagtcctcctgacggcccacgggacgcacccacgtgaagtcaccgaacaccggatcattgacgaacgctcctgccagctcctcggtggtctcaaagtcaggagacgagacagtgacggtgataagagcctggatctcgacctcacgctcatcggcggccagctcggcgttgtagtcgacgagcacctgagcggaatgctcgatagacatgagggtcgaagcctgggtcatctcaccgccctc

SEQ ID NO: 380 - DNA, 1109 bp, Propionibacterium acnes
cccctaggtcctgatgtgggtcgaggtccttggaatgatggaagttcctacacacccatcgccaaagacctcaacatggacaacgctaccttcaccactccctcatctgtgaagagccagtttatgcacggtgttgaaagaggcgtcggtctacgacgaatgcgggttaatggtcttgcggtgtggggcgctgggcgatggcatcgagaacgcgtgagtgggtggcgatccattcggccgcgtcggggttgatgttgcgggcgacggtgtcgatcgctgttacgtagtgggcaagcctgcgaatctcagcttgttggtcagggtgatcgctgatgagaggctcttgatgggaggcgcggttacggacgtggcggatgagctccacgttttcctcgaagtcgcgtcggctacgccccgggtagtgaggcatacctccgttacgtaagtcagtgagagctttccatacggttgcttccaggcgcggggtgagcagaaagcgccagttgtccagtgacagactcgccacgatctgatcaggggtcgcatcgagcctcgcgcgccgcagtcgcttctcggccctggcgacgttacgcgggaaaccaccgagccgatagctcggggattcccaccaacgccgtatgccagtatcggcgctcaggcgcacgtcaatgaagtttctcaggagtacctcgacatggctgatgtcttccaagaacgctttcgagatgcgggtgttccacacgtaccacgcatcgactggttcgatccggtagcggctgagcctggcgggtgagaaccactcctgcaacgtctcacgactcaccgtgggagcgtggtaggattgatgacgataggcctcgggaaggtcaatgccgcgaaatatcggtatacccccgaggtcattgttttgcccaggcccctcctcgcatacttgcggggcgtcattggctgccgtcatctcgtctcttcccggtacgtggctgtccatgttcacgggcaggtacggcaatgaggttcccgcacacaaacctctaccaagcatacgctggcaagccccgacgagacgacgcctccgcccgccacaccaacggtcaccgccccggccacgg

SEQ ID NO: 381 - DNA, 1033 bp, Propionibacterium acnes
ccacggtgacctgccacaggctcggatcagacggggagacggtagcgtcataggcggtgacggtggtgggcgctggaccaggtttgcggggcatgcgcgcatcggtgatcttggccgccaccaggtgttccagattgtccaagtgcccggagtcagaggtcagcagaagagtagtcacctcgaccgcggtggctgaggcgatctgagctgtgcggcggtcgtgatgggtggtgtcagtgctgacagctgtggtgggagcggatgccggggccgccgaacggaccagggcaacggggccgcatgcgactccgcacagcacgagggcaaggaagcctttggtggccatcgatccggtgtggggccagggacccacgttttcctgtgcctgttttttcttggccgaccaacggcgggacttagggttagcggatgcaccttctggggtgcatgctcgtctcaatcgcatcggtcacctccttcactggatgaagggaccaaggaggtgaccgatgtgcggtcgaacccgaaaaagttcaaacttttttctgggtctgcctcaagtacgacagaaggcctgcatcatcacggcgttgtggtagcagatcttgcgtcagcgcaaatgtatgggcctcgtaggagtagctcttaggtgggtcccggtggttgcggccagggcgagggtgtcgggtatgtgtagcgctagtcccgggttcgtggtgtgagggcttttgggtgctgacatgcactacccattgctagacgctgtgctgtggcatggctggacgtctagcagacgggttgacatcacctttaggctggcagcgcccgaggccgcaggccagaggaagcggacagcctaacgattgacgtccccctctcctttccccaacctcctggagtcgatgacccggagatagatcgatgtctatgcatctgtgcatcgatatacctatgtatctgtctgtggtttttagaggccactcccgtcgccccgggccgctcagcgataccgcaaggctgtgtgggatcagct

SEQ ID NO: 382 - DNA, 1171 bp, Propionibacterium acnes
ccagcccgacagccatgccagaggtgaccaggtccagtcgatgcgaccaacaacgaactgggcgagccatccggcagccagcgcgaaaatgaaaccgcggatggtcatgcccccgtcgataattttgaagcccatcatcgcggcaggaactacgccgccgacagcgagcacctgatagatcgtgtagggcccgccaggaatccttcgacctgaggagtccttgccgataatgcggggctgctggcgggcctcggtgtgccactgaatatccacgatcagctcttgcccaatccttgcatcatctgtccgaagaattggatcgcgttaccttcgataagccagtgcgccataccacacacaaacagcatggagacgatcttggccaggctcataccgtgtttgaagatgttgaacgcggcaatgcccacgactacgaccatggcgacggctcgcaccgcggactgaccttcacctgccttgatcgtcgtccattcgaagaggttctgcgattccagtggcagcaggaggaattgatcgagcatgagaggttttcctttcaggaagccgaccgggatggtcccggtactgacgggctggacggcacgggtgtgccggccaggggcagaaggcgtgacggctggtcgagggaggcaacctcccagcggcctgcacggctgacaagagtcaggccgtactggctgggccgggtagtggattcgtcaccggttagctggcatgtcacggtcaccgtgacggtaatcttctgccggtctgagggggtggggacctcgtcaggtcccaccacatgagtggttttcactgatacgcatggggctgggtcaaccgcggtgaaagcggtccccgggctactccatctcgacaggtcgtcgctgccactcagcatcgcggccaagaaacccgaagaggtctgggcagccgggtcagcaggacgaatctccgaggagtccacgtcgggggctgaggccggtgcaggcatggggatctgcccaggtagacgcaaggcgatggccttgccgttggaatcgacgtggaccgggactgaccaggcctgtccgctcccggattggccgcccatggtgaccacggtgacctgccacaggctcggatcagacggggagacggtagcgtcataggcggtgacgggggtggg

SEQ ID NO: 383 - DNA, 1042 bp, Propionibacterium acnes
attatcggcgcgacaaccttactgatgacgctgttggttacgccgtagagcacatcttgtactcgtgggcgctcgacgatgctgatgatcctcgttgctggatgatgattcgtgttgacccagctggcctcctcatggagctagttatcctcatctacgacgatggctatgaactcctgatccacgccatgaaagcccgccctcagtatctgagctacttcgctatctagtgttgttgggcgagttgaactcaacttttctccgacgcaagcgccaataaaaggctgatccatccgaataccaccaaacacggctgaagtgtggaacagattcagcaagacagggtgcggtgctcgggtgcgttggggagatgaggatattcaggcttctggcgggatgtggcttgatgacgtccaggatcaccggttcggttttgaaggtgccttgcattaatgtcgacagggtcgtacgactcgaggattggatcgaccagcccgttgcgtctgaagaacttcatccaccccggtggagctccggccgcgtactggtgcaacggatcattagcatgggtagcgtgagtatgccttcgatcgtggtcagtgctgtcatcatccaagattctgacgggcggcttctcactgtccgtaaacgaggcaccgaggcattcatgctgccaggcggcaagccggagcccggcgaggactcgcgtcaggcagtagtccgggaagtgcacgaagagctcggcgtcgcattgtcttccgacgacctgcgtcgggtgggagtgttcaccacgcgagcagcgaatgaggccggccatcaggtggtggcgacgattttcacccacaccccggttgcggtgagtgagccagctgctgagatcgagcagattcgttggctcgattggagtgtcgacgccctgcctgacgacctggccccgctgctggtcgaggcagtcatcccgtggctgcggcgccgtatccggtcggtcgctgtattcacgggtgcgaaggatggaaccgaccctcattatcgtgtcgaagca

SEQ ID NO: 384 - DNA, 1057 bp, Propionibacterium acnes
cccctaggtcctgatgtgggtcgaggtccttggaatgatggaagttcctacacacccatcgccaaagacctcaacatggacaacgctaccttcaccactccctcatctgtgaagagccagtttatgcacggtgttgaaagaggcgtcggtctacgacgaatgcgggttaatggtcttgcggtgtggggcgctgggcgatggcatcgagaacgcgtgagtgggtggcgatccattcggccgcgtcggggttgatgttgcgggcgacggtgtcgatcgctgttacgtagtgggcaagcctgcgaatctcagcttgttggtcagggtgagcgctgatgagaggctcttgatgggaggcgcggttacggacgtggcggatgagctccacgttttcctcgaagtcgcgtcggctacgccccgggtagtgaggcatacctccgttacgtaagtcagtgagagctttccatacggttgcttccaggcgcggggtgagcagaaagcgccagttgtccagtgacagactcgccacgatctgatcaggggtcgcatcgagcctcgcgcgccgcagtcgcttctcggccctggcgacgttacgcgggaaaccaccgagccgatagctcggggattcccaccaacgccgtatgccagtatcggcgctcaggcgcacgtcaatgaagtttctcaggagtacctcgacatggctgatgtcttccaagaacgctttcgagatgcgggtgttccacacgtaccacgcatcgactggttcgatccggtagcgtctgagcctggcgggtgagaaccactcctgcaacgtctcacgactcaccgtgggagcgtggtaggattgatgacgataggcctcgggaaggtcaatgccgcgaaatatcggtatacccccgaggtcattgttttgcccaggcccctcctcgcatacttgcggggcgtcattggctgccgtcatctcgtctcttcccggtacgtggctgtccatgttcacgggcaggtacggcaatgaggttcccgcacacaaacctctaccaagcatacgctggcaagcccc

SEQ ID NO: 385 - DNA, 1057 bp, Propionibacterium acnes
cccctaggtcctgatgtgggtcgaggtccttggaatgatggaagttcctacacacccatcgccaaagacctcaacatggacaacgctaccttcaccactccctcatccgtgaagagccagtttatgcacggtgttgaaagaggcgtcggtctacgacgaatgcgggttaatggtcttgcggtgtggggcgctgggcgatggcatcgagaacgcgtgagtgggtggcgatccattcggccgcgtcggggttgatgttgcgggcgacggtgtcgatcgctgttacgtagtgggcaagcctgcgaatctcagcttgttggtcagggtgatcgctgatgagaggctcttgatgggaggcgcggttacggacgtggcggatgagctccacgttttcctcgaagtcgcgtcggctacgccccgggtagtgaggcatacctccgttacgtaagtcagtgagagctttccatacggttgcttccaggcgcggggtgagcagaaagcgccagttgtccagtgacagactcgccacgatctgatcaggggtcgcatcgagcctcgcgcgccgcagtcgcttctcggccctggcgacgttacgcgggaaaccaccgagccgatagctcggggattcccaccaacgccgtatgccagtatcggcgctcaggcgcacgtcaatgaagtttctcaggagtacctcgacatggctgatgtcttccaagaacgctttcgagatgcgggtgttccacacgtaccacgcatcgactggttcgatccggtagcggctgagcctggcgggtgagaaccactcctgcaacgtctcacgactcaccgtgggagcgtggtaggattgatgacgataggcctcgggaaggtcaatgccgcgaaatatcggtatacccccgaggccattgttttgcccaggcccctcctcgcatacttgcggggcgtcattggctgccgtcatctcgtctcttcccggtacgtggctgtccatgttcacgggcaggtacggcaatgaggttcccgcacacaaacctctaccaagcatacgctggcaagcccc

SEQ ID NO: 386 - DNA, 1052 bp, Propionibacterium acnes
cggggcggccgtagcagtccaagcggcccgccaggcactatctgctgccggggtggacgggtcggtgcaggaggacgggtcgaccatcacggtgaccacgtctcaaagtcggccgacagtgttcctgtcagcgatcggaatcagccaggtaagggggcatgggcaggcccatgctcagcttgtgggaccgggagaacgcccatgacagtgatacgtcgtatcggtgccctggtggcactgcttgtggtgatagccggcttaccggccgggctcgtggccgcaggcgccccgctagtaccctcgggcctgtcatgggcccatgtgcggcatctgttggttaccccagacatgaccgggtctgtgctggtgtggctggtcagcctcatcggctggatcgggtgggcatggttcgccctggccgtcgcagccgaagcggtgacgatgctctcagggcagcggctgcactggcacatgcccggccctcgcctagtgcgccgagtggcagccggtcttctcattgccgcgttcgcggccgcaccggcagccacaagcacggctcacgccgccgaggccacccatgtggcggtcgccgcccaggctggaccggcacacgcggcccccgcccaggacagccccgccaccacctctcaggccccggacgcctccaccactccgaaaatctggaagacctacacggtgcgggccaacgactacctgtggaagatcgccgagcactactacggtgacggcgcccaattccgtcgtatcgccgaagcctccggtatcgacccgcactcagagctgaaagtcggccagaaactggtgctaccggttcccgagaacacggccgcagttcattcggttaaagcgggggagtatctgtgggagatcgccgagcactactacggtgacggtgcccagtaccataaaatcgctgaagcttccggtatcgatgcccattccgatctagccgtgggccaaaaactcgtcatccccgggcccctccgccacgacgccacgccgccacaccactcggcgtcgacccacgcgaa

SEQ ID NO: 387 - DNA, 1057 bp, Propionibacterium acnes
cccctaggtcctgatgtgggtcgaggtccttggaatgatggaagttcctacacacccatcgccaaagacctcaacatggacaacgctaccttcaccactccctcatccgtgaagagccagtttatgcacggtgttgaaagaggcgtcggtctacgacgaatgcgggttaatggtcttgcggtgtggggcgctgggcgatggcatcgagaacgcgtgagtgggtggcgatccattcggccgcgtcggggttgatgttgcgggcgacggtgtcgatcgctgttacgtagtgggcaagcctgcgaatctcagcttgttggtcagggtgatcgctgatgagaggctcttgatgggaggcgcggttacggacgtggcggatgagctccacgttttcctcgaagtcgcgtcggctacgccccgggtagtgaggcatacctccgttacgtaagtcagtgagagctttccatacggttgcttccaggcgcggggtgagcagaaagcgccagttgtccagtgacagactcgccacgatctgatcaggggtcgcatcgagcctcgcgcgccgcagtcgcttctcggccctggcgacgttacgcgggaaaccaccgagccgatagctcggggattcccaccaacgccgtatgccagtatcggcgctcaggcgcacgtcaatgaagtttctcaggagtacctcgacatggctgatgtcttccaagaacgctttcgagatgcgggtgttccacacgtaccacgcatcgactggttcgatccggtagcggctgagcctggcgggtgagaaccactcctgcaacgtctcacgactcaccgtgggagcgtggtaggattgatgacgataggcctcgggaaggtcaatgccgcgaaatatcggtatacccccgaggccattgtcttgcccaggcccctcctcgcatacttgcggggcgtcattggctgccgtcatctcgtctcttcccggtacgtggctgtccatgttcacgggcaggtacggcaatgaggttcccgcacacaaacctctaccaagcatacgctggcaagcccc

SEQ ID NO: 388 - DNA, 1057 bp, Propionibacterium acnes; identical to SEQ ID NO: 387

SEQ ID NO: 389 - DNA, 1057 bp, Propionibacterium acnes; identical to SEQ ID NO: 387

SEQ ID NO: 390 - DNA, 1057 bp, Propionibacterium acnes; identical to SEQ ID NO: 387

SEQ ID NO: 391 - DNA, 1055 bp, Propionibacterium acnes; identical to SEQ ID NO: 149

SEQ ID NO: 392 - DNA, 1055 bp, Propionibacterium acnes; identical to SEQ ID NO: 149

SEQ ID NO: 393 - DNA, 1057 bp, Propionibacterium acnes
cccctaggtcctgatgtgggtcgaggtccttggaatgatggaagttcctacacacccatcgccaaagacctcaacatggacaacgctaccttcaccactccctcatctgtgaagagccagtttatgcacggtgttgaaagaggcgtcggtctacgacgaatgcgggttaatggtcttgcggtgtggggcgctgggcgatggcatcgagaacgcgtgagtgggtggcgatccattcggccgcgtcggggttgatgttgcgggcgacggtgtcgatcgctgttacgtagtgggcaagcctgcgaatctcagcttgttggtcagggtgagcgctgatgaggggctcttgatgggaggcgcggttacggacgtggcggatgagctccacgttttcctcgaagtcgcgtcggctacgccccgggtagtgaggcatacctccgttacgtaagtcagtgagagctttccatacggttgcttccaggcgcggggtgagcagaaagcgccagttgtccagtgacagactcgccacgatctgatcaggggtcgcatcgagcctcgcgcgccgcagtcgcttctcggccctgtcgacgttacgcgggaaaccaccgagccgatagctcggggattcccaccaacgccgtatgccagtatcggcgctcaggcgcacgtcaatgaagtttctcaggagtacctcgacatggctgatgtcttccaagaacgctttcgagatgcgggtgttccacacgtaccacgcatcgactggttcgatccggtagcggctgagcctggcgggtgagaaccactcctgcaacgtctcacgactcaccgtgggagcgtggtaggattgatgacgataggcctcgggaaggtcaatgccgcgaaatatcggtatacccccgaggccattgttttgcccaggcccctcctcgcatacttgcggggcgtcattggctgccgtcatctcgtctcttcccggtacgtggctgtccatgttcacgggcaggtacggcaatgaggttcccgcacacaaacctctaccaagcatacgctggcaagcccc

SEQ ID NO: 394 - DNA, 1057 bp, Propionibacterium acnes; identical to SEQ ID NO: 393

SEQ ID NO: 395 - DNA, 1057 bp, Propionibacterium acnes; identical to SEQ ID NO: 155

SEQ ID NO: 396 - DNA, 1057 bp, Propionibacterium acnes; identical to SEQ ID NO: 393

SEQ ID NO: 397 - DNA, 1055 bp, Propionibacterium acnes; identical to SEQ ID NO: 151

SEQ ID NO: 398 - DNA, 1003 bp, Propionibacterium acnes
ccagtcctggatcgggtgccggccgaagtcgcgtacgatagccgagtaaccaagttcgccccagcagaactggcgcatcccctctatgtcgcgccagacgtagaagggcgcgtaggagttctggggtgcgcctttgaccttttcttggatgaggtaggccttgaactccagtccatggtagccgtccatgaggtgtccagtctggatgacgcggtcgcggatgatctgcatgtcatagtcggtgggcagggtgatctgatattgcatggcgtacatcagcggttctccttggtttcgtgggagtaggtcgtgggggtgacgggttcctgccaatcgatggttgacaagtcgttggcggcttgttggtaggtaaggtggatcattggctgtttgagtgcagcgccatgccagtgtctctggccggcgtcgatccagatggattcgcccttggtcaggtgctggggtgcttgtccttcaatatggaccagggcaacgccgcccgtgacgtagaggccctgtcccttggggtgtgtgcctcagcggcaaacgtgacggcgtgggcggcacgcccggcgtcttccgtggcacgatcggccggatccatggcggcgcgcagctgctgttctgcagccaggcgtccaggtcacggcgggcagcatcgacacccagggcagcctcgacggcttcagggctacgacgctggccgggctggttgaccgcagaccactggtgccgggcgtcgtccagatcatggccggcggcgtcgatgagggcggtggtggcttcggcgcagcatcgcctgatccactccgaacgtgacaggccagctgtctcggcggcactgtcaatgcgcgccaggagagatttcatgggcgctcatctgtagcctccagataggcgttgatgtagcgcagagcctgatccgtcatgtcgatggcggctgcctcggcagacgacacaacgggctgtggatgataagaccacccaacatagacggcgaaca

SEQ ID NO: 399 - DNA, 1017 bp, Propionibacterium acnes
ctgggacccggtttgggctccggagtcttaggctccggcttcacatgcctaggcacttcggctgcggtgggaggagtcagcacgtggcgtaccggcttggtgaccttctgggcacccgaaacaaccggcttagacaccaccttggcacctttgaccaccggtgcggctgccttcgcgccggccttcttgactgcacgatgcgctttgatagccccggcctcggcccggccaaccctactagcagtagcatcgagggctctgtggcccgtcgttgccctcaccggtgcatccttgccctggcgggtctgcttcgcgatcgccgacatgccgcctcgcaatgccgaaacatgattgtgggcgtgggcgatcgccgacatgccggccgtcgcgatttttgactggccctgcggggcccctgccccagcacgaatctgccggtaagccgccgacgtgccacgagcacccgccgccattcgcgccaccttcgcagccctagtcactcccgtcgacacgccacccgtggctaccgcagcagcacccgagaccacagtcgaggccatccgccttcgacccgatccggtgagcttgcgaccaccactgcgcaccatccggcgagcaccccgcccagcccactggccgatcaccgagcccctttcggaacgcttgctgcgcatccaatcgttgatcttgtccctcagccccttctcgcccttgtgacgacgccacatggacatcaagaacccgataatccccacgagctcgagcatgttgacaaccatgaccttgatggcgacatcaccgtcagaggcgaaaaccgacttgatgatgagcatgaccacacccaacatcaccatcgacccgacaatgccgatcatcgagtacaagatcgaacacagatcccggatgagcggatctgtgcggccagggatagcccgcaacacgttgagcatcgacataaacgccgaccacaccaacttgcacacgtagaaccagcacatgcccgcgaacaccagcagg

SEQ ID NO: 400 - DNA, 1108 bp, Propionibacterium acnes
ccccaatgcccccacaacgatcagcacaccaacagcgatcatcaggtgggcagcactaactgatcccaacgaaccaagatcaaacaagccctgcccgggagcgtcgagcagtccgtgggcgcgaagccatgctccgagattgccaatgatcttggggaccatcttgttcagtagggctatccctccgatgccgacaacgaggaagacgaggatttcttcgcctgcgttgtttcttcctgtgtttgcggtcatgctgccttctcggggtggatggccagccagctgatgaggttgtcggtgatctgccctgagatttggatcagttcgacttgcccggcctgccatgcccgcgatgtgccggcaagcaatgatgctgggacccctactgcgcggccacgggatgcaacctcagccaaggcggcgcgtaactcctcgacggtgctttcgatgtaccaactgccgtcagtactagtctcagcggcatcggtggtagcgataagagcatcggtgaggtcgtcgacggcgcggtccagatcagcgatgtccggtagggctacagcagtcatggtgtgtcttccttctagggtgccttcactggtgaagggtccctagccccggccgatgtgcggtgctgtgggaaaaatgcttcccattggtccgtcttagttaggaaacttggcctaagtgctgtcgagagtcgcgtgttcgtgaccggttcgaagacactgccgctttgccttcttgcccgtggcgcttccgagatgggttcagtgggcgatggctaggccgatgagggcgccgctgcacaggctgggtgcccaggggaggaatcgggtggtgtggtgtcggaaccggtcgatgagggcatatagggcgatcagggtgaggccggctatgaccgtggcgtggatcgtgtcgatgccggttgctgcggccggggctgcccacagtggtgtgatgcgcacgtcggagaagccgaagccgcctcgggagatgagccaggcgatcatccacgctgcgaagatgatggtggtagcgatgacagcacgtgttgccgcagtctggtccgagagggcggtaacggctacagccccgatccatccggccc

SEQ ID NO: 401 - DNA, 1004 bp, Propionibacterium acnes
tgggttcagatttcgaatgtgggaggggtttgtggatgggtatcggtgtcctcggcgagggcttggtcgagcaggcaggtggccggggtgtcggtagtctcgtccagctcgtcgatcatctcgtcgaggaagttgggggtggtggatgcggcccacacaggtgggatagccggtgcgggtcgaggcggtgtggggaggcggagtttggtttggccccagaggggtgtgtgggtcatgccggcgggagtggtggcggcgtgagtggtcacacgccaccagcccgccagccatgccagaggtgaccaggtccagtcgatgcgaccaacaacgaactgggcgagccatccggcagccagcgcgaaaatgaaaccgcggatggtcatgcccccgtcgataattttgaagcccatcatcgcggcaggaactacgccgccgacagcgagcacctgatagatcgtgtagggcccgccaggaatccttcgacctgaggaatccttaccgataatgcggggctgctggcgggcctcggtgtgccactgaatatccacgatcagctcttgcccaatccttgcatcatctgtccgaagaattggatcgcgttaccttcgataagccagtgcgccataccacacacaaacagcatggagacgatcttggccaggctcataccgtgtttgaagatgttgaacgcggcaatgcccacgactacgaccatggcgacggctcgcaccgcggactgaccttcacctgccttgatcgtcgtccattcgaagaggttctgcgattccagtggcagcaggaggaattgatcgagcatgagaggttttcctttcaggaagccgaccgggatggtcccggtactgacgggctggacggcacgggtgtgccggccaggggcagaaggcgtgacggctggtcgagggaggcaacctcccagcggcctgcacggctgacaagagtcaggccgtactggctggtccgggtagtggattcgtcgccggtgg

SEQ ID NO: 402 - DNA, 988 bp, Propionibacterium acnes
cgttgccctcaccggtgcatccttgccctggcgggtctgcttagcgatcgccgacatgccgcctcgcaatgccgaaacatgattgtgggcgtgggcgatcgccgacatgccggccgtcgcgatttttgactggccctgcggggcccctgccccagcacgaatctgctggtaagccgccgacgtgccacgagcacccgccgccattcgcgccaccttcgcagccctagtcactcccgtcgacacgccacccgtggctaccgcagcagcacccgagaccacagtcgaggccatccgccttcgacccaatccggtgagcttgcgaccaccgctgcgcaccatccggcgagcaccccgcccagcccactggccgatcaccgagcccctttcggaacgcttgctgcgcatccaatcgttgatcttgtccctcagccccttctcgcccttgtgacgacgccacatggacatcaagaacccgataatccccacgagctcgagcatgttgacaaccatgaccttgatggcgacatcaccgtcagaggcgaaaaccgacttgatgatgagcatgaccacacccaacatcaccatcgacccgacaatgccgatcatcgagtacaagatcgaacacagatcccggatgagcggatctgtgcggccagggatagcccgcaacacgttgagcatcgacatgaacgccgaccacaccaacttgcacacgtagaaccagcacatgcccgcgaacaccagcaggaccacagccaaacccgccaccgtcgacgagtaaaagaagaaccccaccaaccacgaaccatccgcaatatcgccggcgtaatccgacaacccctcatcacagtcaccaaggtcgtcgcgagcatccgagacgtcatcgtaagggccacccttgagcacctcgatgtacttgtcgtggcacttcgcatcaataatgcggccatagttgagctgctgatgaaccggcgccacgaacgagtcc

SEQ ID NO: 403 - DNA, 1053 bp, Propionibacterium acnes
cgattttgtccacccacccctgtcgattttgtccgccaagtattagacaaaccattagacagtgaattagaccctgggtcgcgtcagcgtgttagctcaccaacgcgcgcgcgcgcggcggccgagccgccgaagccaaagaaacccataccaccaacgcctgaaccagcagcccccgcttcagacagtcctgtgtcagcgcacgctgatgaggctgccgagttggcgtggcggttcgtggggtggtgtcctcagctggtaggggcaccgaagaaggtgcgtggccagctccgtcagctggtcgctgccgagatccgccggaatccgggctggctggatgcgccagcgttggaggttgttgcccagcgggtacgtgctgaaggtgcgctgggggtccagcactgcgagattgtgcgagccgagctgcacggggtgatcgccgaccagaaggccgcccccgcccgccccgacgccctgcacgcgcgggagcccaagtggtgggacgacgtgtactacgaaggaaacacaaccgtgtggtacgactctgacgaaaccagtgacgacgacgaggcgtggaaccggtcgcaggtatgtcatgttgctgagcgtgacgacatggctggcgggattgctaccaacctgctggcctcccacgctgatgatccgatggcctggctgactcgccgtcaaaccatgctgatggctcgtttcccccacgcccagaacgaggtcatcgcgatgtgccacatcgtgcgcaccgccctggaggccgacatggccgccggaacccggtgggaggactgatgagggtctcccggcgcgccctcatggccgtggcccgtgccgacgctgccgcagcagaccatgccaccggccgatgggtggccacagccaacgccaccgtcgcccggctgaccggactgtgcgaacgcaccgtccaatacgcccgcgccaccctggtccacctgggcctgtgccgcgtcgtggccaccggccgctacctcaccgccgacgagcggcgcacggctgctcgcacccatggcggccgccaga

SEQ ID NO: 404 - DNA, 1009 bp, Propionibacterium acnes
gcgagccacgaccatcgccaagctgaatggagagcgagcatgagcaccacccctgccgggttcgacttcgacgctctggccgagtgggccgagagcgatgaggcgacccacaccccgcaaaccagccccgtgttccggggcaaggacgccgcgcgcgccagccgcgcattcctcggccgaggacggcccaccctcggcgcggaccacgccaccggcgagggccggtcgccccgccgtcaggtacggctcgacgcacgcaccaacgcgcgactcgacgcctacgcagccgcaaccggcaccagcgcctcccagatcatccgcgacgccctcgctgactacctgcccgcctgatcccaccccaatccactcgggcgcctgtcagtgccccctcttctgggtggtggtccggggcgtcaccgccccggaccagttgggtagtcatctcagttgaaataagcgattagtgatacgcccctcctgctttccggtgctgtcatgagcgtctgacaacagcgacacctcggggcagccgacggacagtcctctggctgccgctctgatcccatgcccacggcacgaaggtgtcggacagctcggtctcatcatgtgcccaaatagcgtcgtgggcctgtcgccaagcttctcgggagccccacacgggcacgaccgggccacaccggtgtcctggtctccagtgtcgcgacactgtcgatttcggtacgtgcaatgcggcggcggtttgacggatcgacatcccagactcccgcgcgtcccagatcgccatgtggagagtatttgcctccagtgcggccgccacacttgcacgctctcgcgcacgctcgaatgcccgcctagtgctctcaaatgtcgtcacgacgcctccccctgaaaatactcagggtgtcccacggtgggacaccctgagtatttcataccccaactcgcctcaccacacgtcgacctcgacaccgatcaagcgacccgtatcggcgacattgccgtactgctg

SEQ ID NO: 405 - DNA, 1029 bp, Propionibacterium acnes
caggtgggtttgaccgccagcgtcggattggtgctggtcgctgggctgatcaccactctcaaccgtcgttaccggacccggttcacccgtcagccccgcggcaaggccatgaccctgcccagcccggacgcccaaactgccgagatagcgctgcgcagcaccggggcgactgacactctgacgatcacctgcctcgaccaggcgctccgcgcgatcggcgcatggtgccaccactgcgggcacccgctgccacccctgctggccgcccgcgtcgatgacgaccggatcgacctgctgctatcccaggcggcccccgaccatcccgaggcggtggagctggccgccgacggatcggtgtggaccctcaccgccgaccggatcgacgacctgctagcccacaccgatgacaaccaagcggctccgtggccgtctctggtcacactgggacgcgacgacgacggcgcccacatcctcatcgacttggaagccgcaggaaccttgcacctgatcgccgatgacgaccaggtcgacgcggccctcgccgcgatcgccgtggaactggccacctgcgactggtccgacgaagtcaacgtcaccctcgtcggccaggtgtgcccgggcctagaagacgcactagagtctccgaccctgacccgcgccaccgacgtggacaccctcctcaccaccctagaagctcgcgccgacgaccagcgacacatcctcaccgaaggaaaccccctcgccgctcaccgagccgaccccgccatctccgacgggttcgacgccgaagtgatcctcctcgacaccaaactcaccgaagaccaccgcaaccgcctcgccagcctcgtcgaggctcttccccgcgtgtcagtcgccgcggtaacaaccagccccaccagcccagacgaatggtccctcaccctgacaggtgacccactagccgccgacctggctcccctcggctggcacatccacccccaaaccctctcccccgacctgtacaaccgcgtggttgaactgctcgccaac

SEQ ID NO: 406 - DNA, 1024 bp, Propionibacterium acnes
ccagcaggaccacagccaaacccgccaccgtcgacgagtaaaagaagaaccccaccaaccacgaaccatccgcaatatcgccggcgtaatccgacaacccctcatcacagtcaccaaggtcgtcgcgagcatccgagacgtcatcgtaagggccacccttgagcacctcgatgtacttgtcgtggcacttcgcatcaataatccggccatagttgagctgctgatgaaccggcgccacgaacgagtccacaatgatcgccgacagcttcggatccttcgagtctcccgtcgaggtcatgtcatcaggaatctcgacctcaccagcggtcgccgtcgcaggatcaaccgaactagtaatcatccgagacagcgccacaccgaactgctgggtgcgagccaacggagtagccaacgtcgtcgtatcgcctgcgaacttcgccaccggggccgccaagaaacccaacgccagcgccgcagcaatcgccgcacgcgcacccgtagcccacgccccagccgtacgtcccctcatcatcttgacgaccacgcccacaccggcgcacgtcgtcagcaacgccaacaccgttccaccccagctgtccgctcccagcggggccaaaaccttgtcgtggatgtcgttctgcaaccccaccagcggtccggtaatccacccgacccagctcatcgccacggtccagtccaacaaccggcacaacagggcaacgaccatcaggtacgtgttccaacacatgccaataatggaggcccacatagccttcagcggggccgtaacgccaccatcgtccatcgacatctggtactgaaacaagtgaataccgttggagtcagtcacattgaaaccgtcacccatccagcccagcccaggacccgacgccatggcaggcacactgctcagcgccaccaccagaaccagcgtggtgacgatgatacggaaccgccgctccccggccccggggcggcgtggatgacggctcacgctgtctcccggtcgtgctcgggcgggttg

SEQ ID NO: 407 - DNA, 985 bp, Propionibacterium acnes
tccctgcgaccagtgaaccgtgcccccactgcgcccacaatgatcagcacacccacggcgatcatcaggtgggcagcactaactgatcccaacgaaccaagatcaaacaagccctgcccgggagcgtcgagcagtccgtgggcgcgaagccatgctccgagattgccaatgatcttggggatcatcttgttcagtagggctatccctccgatgccgacaacgaggaagacgaggatttcttcgcctgcgttgtttcttcctgtgtttgcggtcatgctgccttctcggggtggatggccagccagctgatgaggttgtcggtgatctgccctgagatttggatcagttcgacttgcccggcctgccatgcccgcgatgtgccggccagcaatgatgctgggacccctactgcgcggccacgggatgcaacctcagccaaggcggcgcgtaactcctcgacggtgctttcgatgtaccaactgccgtcagtactagtctcagcggcatcggtggtagcgataagagcatcggtgaggtcgtcgacggcgcggtccagatcagcgatgtccggtagggctacaggagtcatggtgtgtcttccttctagggtgccttcactggtgaagggtccctagccccggccgatgtgcggtgctgtgggaaaaatgcttcccattggtccgtcttagttaggaaacttggcctaagtgctgtcgagggtcgcgtgttcgtgaccggttcgaagacactgccgccttgtcttcttgcccgtggcgcttccgagatggtcagtgggcgatggctaggccgatgagggcgccgctgcacaggctgggcgcccagggaaggaatcgggtggtgtggtgtcggaaccggtcgattagggcatatagggcgatcagggtgaggccggctatgaccgtggcgtggatcgtgtcgatgccggttgctgcgaccggggctgcccacagtggtgtgatgcgca

SEQ ID NO: 408 - DNA, 967 bp, Propionibacterium acnes
ggtgggcgctggaccaggtttgcggggcatgcgcgcatcggtgatcttggccgccaccaggtgttccagattgtccaagtgcccggagtcagaggtcagcagaagagtagtcacctcgaccgcggtggctgaggcgatctgagctgtgcggcggtcgtgatgggtggtgtcagtgctgacagctgtggtgggagcggatgccggggccgccgaacggaccagggcaacggggccgcatgcgactccgcacagcacgagggcaaggaagcctttggtggccatcgatccggtgtggggccagggacccacgttttcctgtgcctgttttttcttggccgaccaacggcgggacttagggttagcggatgcaccttctggggtgcatgctcgtctcaatcgcatcggtcacctccttcactggatgaagggaccaaggaggtgaccgatgtgcggtcgaacccgaaaaagttcaaacttttttctgggtctgcctcaagtacgacagaaggcctgcatcatcacggcgttgtggtagcagatcttgcgtcagcgcaaatgtatgggcctcgtaggagtagctcttaggtgggtcccggtggttgcggccagggcgagggtgtcgggtatgtgtagcgctagtcccgggttcgtggtgtgagggcttttgggtgctgacatgcactacccattgctagacgctgtgctgtggcatggctggacgtctagcagacgggttgacatcacctttaggctggcagcgcccgaggccgcaggccagaggaagcggacagcctaacgattgacgtccccctctcctttccccaacctcctggagtcgatgacccggagatagatcgatgtctatgcatcggtgcatcgatatacctatgtatctgtctgtggtttttagaggccactcccgtcgccccgggccgctcagcgataccgcaaggctgtgtgggatcag

SEQ ID NO: 409 - DNA, 1055 bp, Propionibacterium acnes; identical to SEQ ID NO: 159

SEQ ID NO: 410 - DNA, 997 bp, Propionibacterium acnes
cgctcctgccagctcctcggtggtctcaaagtcaggagacgagacagtgacggtgataagagcctggatctcgacctcacgctcatcggcggccagctcggcgttgtagtcgacgagcacctgagcggaatgctcgatagacatgagggtcgaagcctgggtcatctcaccgccctcgacgttgtcgagctggtcgacggtttggcggatggcccgctgatttttctgcatcgcagcgtgacgggtccgggccactccccggatcgccacgtcgaccggcacgccagtgtcgtcgatacggcccaggaactcgtaggcaggccacgtcatcgtgcggggcaccttgcccagcgcaatgtgggactggtagacggtctcgccggtgtcggcaccgattttgaggacgcgacgattccacgcctgagccgtccgggacatgtgggagactcgcttgtcatcctcgctggccagcaggtcggaggtcgcggcctcatcgatgaccaactcccccagcgcggcacgtccaacctcatccatgagggcgattccctcgccaggggcatcatcacgcaaccgggtcgggtggcctgacaggtgctgccgaagccagatctgttcatcaacggtgaccgggcggggttggaacgctgccggcagtttcgcaccgaattccttagcctgacggagggcccactcccgtgcgacacggccaggagcggtggtcatgagtccggcggcttcggtgattttgttgagggcggcggtccaggcggtgtgggtgcgtattttctggtcttggttgagtttgatcgataggaaccacacgcgccggcctagggattcggtttcaggctggtcgagggtggcgtcgatttcgtcggcccacacggggtgttcgctcaggtcgaggccggcggccatggcgtcgacgatttctgcggggtcggtccaggtgagggctccgttgaggcagaactcgtggcgggcgaggtggcgg

SEQ ID NO: 411 - DNA, 1162 bp, Propionibacterium acnes
cccatcgtttacatcctcgactggtccctgcgaccagtgaaccgtgcccccactgcgcccacaatgatcagcacacccacggcgatcatcaggtgggcagcactaactgatcccaacggaccaagatcaaacaagccctgcccgggagcgtcgagcagtccgtgggcgcgaagccatgctccgagatgaccgatgattttaggggccatcttcttcagcagggctatccctccgataccaacaacgatgaaggcgaggatttcttcgcatccgttgtttccttctccggtggggccgttcatgctgccttctcggggtggacggccagccagccgatgaggttgtcggcgatctgccctgagatttggatcagttcgacttgcccggcctgccatgcccgcgatgcgccggccagcaatgatgctgggacccctactgcgcggccacgggatgcaacctcagccaaggcggcgcgtaactcctcgacggtgctttcgatgtaccaactgccgtcagtactagtctcagcggcatcggtggtagcgataagagcatcggtgaggtcgtcgacggcgcggtccagatcagcgatgtccggtagggctacagcagtcatggtgtgtcttccttctagggtgccttcactggtgaagggtccctagccccggccgatgtgcggtgctgtgggaaaaatgcttcccattggtccgtcttagttaggaaacttggcctaagtgctgtcgagggtcgcgtgttcgtgaccggttcgaagacactgccgctttgccttcttgtcagtggcgtttccgagatggggtcagtgggcgatggctaggccgatgagggcgccgctgcacaggctgggtgcccaggggaggaatcgggtggtgtggtgtcggaaccggtcgattagggcatatagggcgatcagggtgaggccggctatgaccgtggcgtggatcgtgtcgatgccggttgctgcgaccggggctgcccacagtggtgtgatgcgcacgtcggagaagccgaagccgcctcgggagatgagccaggcgatcatccacgctgcgaagatgatggtggtagcgatgacagcacgtgttgccgcagtctggtccgagagggcggtaacggctacagccccgatccatccggcccatcc

SEQ ID NO: 412 - DNA, 933 bp, Propionibacterium acnes
ccccgactaccagacccgccgtcgtgaacgcagggaaaccctgcgagccacactcagggccgcccagcagcatgtcaggacacactgatacccgctcatacacacaccatgaaacacgacaagccacctgacagtatcagctgcaagacgcatgacaacatagaaggacatgatgaaatacacatagacacaaccccgcacagcagtttcgcaacaaatcatgatagtctcatggcagtatcgcttgatacacacatagcatcactcccacataggcagttatgctgatatactcctactaggttatccgtccaacatgctgagtgggttcctgtacagcatgaaaggagcatggcatgatatgggccgttctcaactgcaagggtggtgtcggcaagacgaccagtgccctcctgctggcggcagccgccgccaagcagggccacaccaccctggtggccgacgctgacccccagggcaccgcatcccagtggtcagccctggcaaccaaaaacgacgaacccctgcccttcccggtgcaagcggtcaacatcgccaccatggaggcactgcccaccaccaccgacgcccatgatctcatcctcgttgacacacccccctcggcaggcgatctgatgttccaggcatgccgcatcgccgacctcatcatcatccccaccgccacctccggacccgacatctcccgaacatgggtcaccatggacgccacacaaggcacaccacgcgcgatcctcctcacccaaaccgaacacaaccgtgtcgtctaccgccaagctcgcactgccctcgccgccgacgacaccgtcgttctcctggaccacgacatcccccgccgtgaatccatccgcacagcatggggcaccaaccccccagacgacgtcatcacctactacctgcccgtcctcaacgaac

SEQ ID NO: 413 - DNA, 928 bp, Propionibacterium acnes
gacgacgacgaggcgtggaaccggtcgcaggtatgtcatgttgctgagcgtgacgacatggctggcgggattgctaccaacctgctggcctcccacgctgatgatccgatggcctggctgactcgccgtcaaaccatgctgatggctcgtttcccccacgcccagaacgaggtcatcgcgatgtgccacatcgtgcgcaccgccctggaggccgacatggccgccggaacccggtgggaggactgatgagggtctcccggcgcgccctcatggccgtggcccgtgccgacgctgccgcagcagaccatgccaccggccgatgggtggccacagccaacgccaccgtcgcccggctgaccggactgtgcgaacgcaccgtccaatacgcccgcgccaccctggtccacctgggcctgtgccgcgtcgtggccaccggccgctacctcaccgccgacgagcggcgcacggctgctcgcacccatggcggccgccagatgcgcgccgcctccacccgcgtcctcaccatgtcctgcgcaatcgtttgcgccctaccccgaaggggtcaccactacaggaaagttaagttcctagatggtcaccaacgcacgcgcaggcgcgtgcgaaggccagcaacaccagagaagaaacccctgtggctgcaaaaactcgcagccctcctcgaccagcacctgccctggctggtgagaaaccatcacatcggccgactgtgccacgccctcaccgccctgggcatcgacgaacactggcaacccgcagacctcgacgccctcctcgacgccatgaaccgcaggaaccgtcgcctcggcctcgacgtgccatgcgccgacgaccagcacaaccccttgggactgttcatccatcaggcccgagacaccctcacccacgacaacccccatgaacgccgcct

SEQ ID NO: 414 - DNA, 957 bp, Propionibacterium acnes
ggcagggtcgtcgggttcttcggttacctcgggtggggtcgatctggctgtctcggtgtcgtcggccaggtcggctcccaggatgcgttcccattcggggctggttttcttgcccgctgaggccatcgtctcgtcgatctgttcgtcagtgggccacacaaatttctttttggtccaggtcgtggtgtcgggtcgcagctgatccagcagttccaggtcttgcggggagtgggccttgcgggggtcgggggtgtagaagaattggacttccttgggggctgattcgccggataggtaggtgcctcggccgcgtttgccgaacgggatgcccacgccgacgtgttcggagccgaacatcatgcgggctccgtcagcggacaggggtccggtggcggcacgcccggagaagttgtctcggatttcgccgcccaggaactcggcgtcggggcgttgggtccccagatcgacgtggatacggcaggcggctgccatgcgcagcagggagccgatccagccgaaaacggggcattctccgggcatcccagagaccttgatcgttgaccaccagtttttcgcgttgccgtagaactggcggtactcgtcgatgaggaccagcacgcgggtgaagtcggtctcgcgggccccttcttcttcgatgcggcggtagcggtcctccatgagagaccacagccagtggatgagggcgacctggtcggggacggtagtggcgaccatctcgatgttgggccactcccgcaggcccaggtactcgatgcgtttagggtcgatgacgaagacgcgccagttgcggcgggcaccctcgacggcgtcgccgatcatggacaccgtttttccggtacgggtgcggccggccttgagctggtgggccatgacaccggagatgtcccagaaacaggtgttgccgtcctcgtcgacggcctgggggattttctccca

SEQ ID NO: 415 - DNA, 947 bp, Propionibacterium acnes
ggctccggagtcttaggctccggcttcacatgcctaggcacttcggctgcggtgggaggagtcagcacgtggcgtaccggcttggtgaccttctgggcacccgaaacaaccggcttagacaccaccttggcacctttgaccaccggtgcggctgccttagcgccggccttcttgactgcacgatgcgctttgatagccccggcctcggcccggccaaccctactagcagtagcatcgagggctctgtggcccgtcgttgccctcaccggtgcatccttgccctggcgggtctgcttagcgatcgccgacataccgccccgcaatgccgaaacatgattgtgggcgtgggcgatcgccgacatgccggccgtcgcgatttttgactggccctgcggggcccctgccccagcacgaatctgccggtaagccgccgacgtgccacgagcacccgccgccattcgcgccaccttcgcagccctagtcactcccgtcgacacgccacccgtggctaccgcagcagcacccgagaccacagtcgaggccatccgccttcgacccaatccggtgagcttgcgaccaccactgcgcaccatccggcgagcaccccgcccagcccactggccgatcaccgagcccctttcggaacgcttgctgcgcatccaatcgttgatcttgtccctcagccccttctcgcccttgtgacgacgccacatggacatcaagaacccgataatccccacgagctcgagcatgttgacaaccatgaccttgatggcgacatcaccgtcagaggcgaaaaccgacttgatgatgagcatgaccacacccaacatcaccatcgacccgacaatgccgatcatcgagtacaagatcgaacacagatcccggatgagcggatctgtgcggccagggatagcccgcaacacgttgagcatcgacatgaacgc

SEQ ID NO: 416 - DNA, 926 bp, Propionibacterium acnes
ccctgcgagccacactcagggccgcccagcagcatgtcaggacacactgatacccgctcatacacacaccatgaaacacgacaagccacctgacagtatcagctgcaagacgcatgacaacatagaaggatatgatgaaatacacatagacacaacccagcacagcagtttcgcaacaaatcatgatagtctcatggcagtatcgcttgatacacacatagcatcactcccacataggcagttatgctgatatactcctactaggttatccgtccaacatgctgagtgggttcctgtacagcatgaaaggagcatggcatgatatgggccgttctcaactgcaagggtggtgtcggcaagacgaccagtgccctcctgctggcggcagccgccgccaagcagggccacaccaccctggtggccgacgctgacccccagggcaccgcatcccagtggtcagccctggcaaccaaaaacgacgaacccctgcccttcccggtgcaagcggtcaacatcgccaccatggaggcactgcccaccaccaccgacgcccatgatctcatcctcgttgacacacccccctcggcaggcgatctgatgttccaggcatgccgcatcgccgacctcatcatcatccccaccgccacctccggacccgacatctcccgaacatgggtcaccatggacgccacacaaggcacaccacgcgcgatcctcctcacccaaaccgaacacaaccgtgtcgtctaccgccaagctcgcactgccctcgccgccgacgacaccgtcgttctcctggaccacgacatcccccgccgtgaatccatccgcacagcatggggcaccaaccccccagacgacgtcatcacctactacctgcccgtcctcaacgaactcatggaggccctgtcatgaccaccaagaaa

SEQ ID NO: 417 - DNA, 930 bp, Propionibacterium acnes
ccggtttcggctgttgcttcggtcttcatggtagctgatagcccgcgtcgttggaagtgcgacgacgccgatcctcatcggtatcgcaccctgttccagggtcgagaatgtgaaggattaacaaccatgacaagtcatgagacgccctccctgagggcgtcatgaccgctttaattcaagctctgccgacagctgaactgtctgctggacctggtgctagcagtccagctagaccctctgctgagggcttcatcaagattcatcacgaccttattagtgcgggcgtgtcgggtaacgcgatggcgttgttcgtcgcgttacgtaaccagcccggctgtgatcagtggacccgtcactcgtacctgcggctagcccaatggtgcggctgggatgggctgtcggaggcggcgggctgtaagcgggtgcagcgggccgctgctgagctcgctagcggtggttggctggaatcgcgggtcggccatgatcgtcgcaccgctaagacgctggtgtggcatcggttgaccagccccgacaccgaccgctgggagcaattgccgcggattgtgtgggcgaggatctgccagatcgccggggagacgtcgggagagtgggtgaggcattggctggtgtggcggatgctggccggtcgtactggtgtggctcaggcccctatgtccatcgtggctcggttcctgggctgttcttcgcgccaggtctctcatatccgtggggctctcgttgatgccggtctgctcggctgtgacgaggtctcgggggcggcgagccgggtgtggttcccctcgatggccgaggagtgtgcagcggatcgtgaggtggttgatggggccgtcgtcgatgctggggtgggctctggtgaaggtgtcgaggagggcggggaacccctgtcgattttgtccacccacccctgtc

SEQ ID NO: 418 - DNA, 909 bp, Propionibacterium acnes
aaccaggaacgaggacgataggccgatgctggtcaggtcgcgatgttgaagtcatggagacatatttgcacagtgcgcggacaagggagtggcactatttctggcatgaatttagatctgggtgtccggtgaggcgatcagaacgcctccatgtactgtccgagtgtctacgatgcagcggacacagtcgagcagctggctcacaagtttccaggtgtccttctgcccctatgagggaagtcggctgctctcgcaacctttgagggctgctctggggtcggaaccagttacagatcgttcaagttccgggaactaccgccggtcacgctgattgattcccgggcgatctcgcttctgacgacagtggtcggtgaccgagaggcgtcctactctgaccccgctgctgcggtgagtaaatcacgggcgtcccggatccggccacccgtccaagtgccagccagcttgatcggctaggcatcgtcaaggagcgacgatgaggtgatgatgcgatgtgagcgcaccgcgaagtgaggtataaagaagccttcccgggcgcatgcgtcgcccaggaaggccaggttggcccctggacggctgaatggttgggcggatcaggctgtagcggagacgtgcagtacctcgtaggcgatggcgttggttgggctctggtctgcatcgtggctactgagttcgacgaggatgacggtccaggtggtgatgtcgacggcggtgacgcgggcgatggtggaatcagtggatgctgcaaggaagtcggcggttatgtcttcgatgcagtgggacggagcagtgctggtgggcaggggcacggtcttgacggtcaggcttcgggcagcagagtaatcggcggttccgttaacaagctggtggacggtccagtcctggatcggg

SEQ ID NO: 419 - DNA, 939 bp, Propionibacterium acnes
gtgacgacatggctggcgggattgctaccaacctgctggcctcccacgctgatgatccgatggcctggctgactcgccgtcaaaccatgctgatggctcgtttcccccacgcccagaacgaggtcatcgcgatgtgccacatcgtgcgcaccgccctggaggccgacatggccgccggaacccggtgggaggactgatgagggtctcccggcgcgccctcatggccgtggcccgtgccgacgctgccgcagcagaccatgccaccggccgatgggtggtcacagccaacgccaccgtcgcccggctgaccggactgtgcgaacgcaccgtccaatacgcccgcgccaccctggtccacctgggcctgtgccgcgtcgtggccaccggccgctacctcaccgccgacgagcggcgcacggctgctcgcacccatggcggccgccagatgcgcgccgcctccacccgcgtcctcaccatgtcctgcgcaatcgtttgcgccctaccccgaaggggtcaccactacaggaaagttaagttcctagatggtcaccaacgcacgcgcaggcgcgtgcgaaggccagcaacaccagagaagaaacccctgtggctgcaaaaactcgcagccctcctcgaccagcacctgccctggctggtgagaaaccatcacatcggccgactgtgccacgccctcaccgccctgggcatcgacgaacactggcaacccgcagacctcgacgccctcctcgacgccatgaaccgcaggaaccgtcgcctcggcctcgacgtgccatgcgccgacgaccagcacaaccccttgggactgttcatccaccaggcccgagacaccctcacccacgacaacccccatgaacgccgcctggcccgcgaacaccaccgcgcccaactcatcgacgaccaactccgccgccgcgcagaaac

SEQ ID NO: 420 - DNA, 967 bp, Propionibacterium acnes
gacgccggccaccccaactactccgacccacacggtgaccccagctccggcctctgccggccactcgaccagcgacgagcacccaatccatacggataccgccacagcggacaaggccagcaacgaggacgccctgtccccaatccaggtgggcttgaccgccagcgtcggactggtgctggtcgccggactgatcaccaccctcaaccgccgctaccggacccggttcacccgccagccccgcggcaaggccatgaccctgcccagcccggacgcccaaactgccgagatagcgctgcgcagcaccagagcagccgagactctgacgatcacctgcctcgaccaggcgctccgcgcgatcggcgcatggtgccaccactgcgggcacccgctgccacccctgctggccgcccgcgtcgacgacgaccggatcgacctgctgctatcccaggcggcccccgaccatcccgaggcggtggagctggccgccgacggatcggtgtggaccctcaccgccgaccggatcgacgacctgctagcccacaccgatgacaaccaagcggctccgtggccagctctagtcacactgggacgcgacgacgacggcgcccacatcctcatcgacttggaagccgccggaaccttgcacctgatcgccgacgacgaccaggtcgacgcagccctcgccgcgatcgccgtggaactggccacctgcgactggtccgacgaagtcaacgtcaccctcgtcggccaggtgtgcccgggcctagaagacgcactagagtctccgaccctgacccgcgccaccgacgtggacgccctcctcaccaccctggaagctcgcgccgacgaccagcgacacatcctcaccgaaggaagccccctcgccgctcaccgagccgaccccgccatctccgacgggttcgacgccgaagtgatcctcctcgacaccgaactcaccgaagac

SEQ ID NO: 421 - DNA, 882 bp, Propionibacterium acnes
ctctacggggccatcatcgccgcctccaccctggacccccacctcagcatcgacgccctagcccgcctctaccagctccccctcgacctcgtgacccaagccctcaccgtctaagcgtcgatgagcgggggagaggtagcgcactatcggctaaggaaccccacaaacaccaaacccttgtcactgggaagggtttggtgttatgctggtctcacaactcaacagaggaggtgagacatgggaaatgagtaccagaagtcgctcaaagtcctgttcaagaaactggaatctgagcaaggagcccgcatcgagacccggcgcaaaggatggatgatctacccgccggatacgtcacgatcagcggtcatgatccacaagactccatcagatcgcagagcatgggccaacatgctttccgaactgagacgctcaggattcaccgtctaactcagtgaagggggctggagctccagccccctttcaaccacctcccccggacaccacacaagaaaaggagaacatgatgtggcacgttcggttgtcgcttcgcgcaatcagcgaggacatgctgttcgacgccctggacaccctcgaccccttatccccggtggccacactgggccccgatgagcacaccggatcattggcggtgttcgtcgaggctgactcactgacagacgccatcgagactgcccgcacagccatcaccaacgcatgcaacaccgccaccataaccggcgtagaagcccgccccgaagacgaatgcttcgcagacgttgaccggcccctgttcccgccagtggtcggatacaccgaaatcgctgaaaccgcaggactctcacgtcagcgcatccgccagctcgcaggcaccgccgggttccc

SEQ ID NO: 422 - DNA, 880 bp, Propionibacterium acnes
agttggtatgcccgcgataagaagggcaccgtcaagatgatcgcattcaactcaacggaggtccccacatgcgacgtcaagtaatcaccgcggccgtactgggcctggccctggccaccacctccctgcccgccctcgcaggcggcggcgacttgaacggcagtgtggacacggatggccctggttacgatgtgcgtactgaggtggattaccatcacaccaccggtggtgcgggtgggggtgccacgacagggggccatcatgggggcaaaacccacggtgatggtgaaggtgaggctattgatgggcgttctcgcgccgatgccgaagccgaactagacgaagccgaccgtaaccaggacttgacttgtgatgtcttgctcccaccggcgccgaataccccagccggccaggaatgggcgaaagaatgcaatcccccagcgaaaaaggggcagaaggccaccccgaagcccgatccggtgttagtgggccgtcacgcggccttgcagctcacccttcccggcgcggcccctcgtatcgatccgtcccccgaccttaaccggtggcactcggcagcagtgggccaggctttgtggttgtcggttgatgaccccaccgccactacgcagaaatcgatcacgtttatgggccaggttgtctcgttgagcgccaaacgtaacggtttgtcgtttgatatgggtgatggtcatgtcgtgcactgtgatgccacgacgacatggacggagtcggtggaaccggggaccccctcacccacgtgcggttacacctaccaacaggcagccccggccgggggctataaggtcaccgcaatcacgtcgtgggatgtgacctggtcggtactaggacacacgggcacagt

SEQ ID NO: 423 - DNA, 1061 bp, Propionibacterium acnes
gaaggttccctagacccggccgatgtgcggttctgtgggaaaaatgcttcccattggtccgtcttagttaggaaacttggcctaagtgctgtcgagggtcgcgtgttcgtgaccggttcgaagacactgccgccttgccttcttgcccgtggcgtttccgagatggggtcagtgggcgatggctaggccgatgagggcgccgctgcacaggctgggtgcccaggggaggaatcgggtggtgtggtgtcggcagcggtcgatgagggcatatagggcgatcagagtcagcccggctatgacagtgacctggatcgtgtcgatgccggttgctgcggccggggctgcccacagtggtgtgatgcgcacgtcggagaagccgaagccgcctcgggagatgagccaggcgatcatccacgctgcgaagatgatggcggtagcgatgacagcacgtatcgccgcagtatggtccgagagggcggtaacgactacagccccgatccatccggcccatccggtccacgctaggactgccggtatccatgtggtgatggcgtcaatgacggcaacccatgccccgatggtggctagcagggcccacgtcggccacgtgggtgctggggcccacattgtggcggcgatcatggtgaccgcagccgcggcacagaccgcgatcaagcttcggagactgtaggtgtcgcggtagacgatcttgtcggggctggcggtagctggttcgggcaggacgcgggtgagggcaggccatcctgcgaccgcaatagccgcgacggcgaccacccacacgatctgttgcatgggtctcatcatggcccatcatcgatgagtatgggtggccgacatggggtcactcgtagaggggatcgaggggtgtgcgggcgagcatggcttcctgtgtgccgagcatgagggtgccagaatcctcgccagccgattcccagtcgacgatgacctggtcgccgtcaacgctggattcggcgatggtcacccattgcccgtccatgtcgatgagcatcccggcggccagctctgtggcggcaaccggg

SEQ ID NO: 424 - DNA, 26620 bp, Propionibacterium acnes
ccttgtggacaccacgtcatccacatgacttgtgtcacatgattcccggaccatcatcaagcagatgctcacccaactgtaatgatttctgttctgaatctggacatgctctgacctgcattcaatgatcaattccgtgcgatattccacaacgcacggggaggtcgcagacaatgacaacagaaagcatccccacgcggctgctcgtgtggcacgagcagaccgatccgaccaagctcctcaggatcaccgacgcgatcaggaggggggatccccttccccccatcgaggccatggcgatcggccacagattcctcgtcctcgacggtgcgcaccgggcccaagcccaccagtactgccatcgatctgagatccgagcccgcctccacaacctccccctcagcgcggaaataccaggctggagccactccataccccgcgatgcagcagcgaaactggctcacctactcctccccgtggacgctctcggtcaggcggaaatcgtcctgcacggggtgcgccgtcaggtggggaccgcttcacaacgaccgcgcgacatctttctcgcctgccaccggatcgcgcgagttgcctacgcgcatggaatcagacctctcggcccggagttctccaacgctccgacgatcgacgccgccaccatgacctggcgcccgccgaacgtgggcacgttgtgggccatcgccagcagtctcggacccctgcccgcaactgtgacccggttcgccccgatcctccggcacgacgccatcggggattccgcgatgacacccgtcacctccgccgcgtgacgacccgcgccaattccgccccaccactggatgaggggcagccgcgtggacgatgctcctgttcaggcagggactccatacgagaccaataggaaaatcatgatcaaaaacacaagccctctgaccgtgaaaaatgtctcgaaaacattccgtggctccagcggagaagccatcaaggccgtgcaagacgtgtcattcaccgttgagcgtggtgaggttgtggcattcctcggcccgaacggcgccgggaagtccaccaccatcgacatggctctcggcctcacccgccccgacagcggccagatcgaggtcttcggtactgacccgctcagcgcggcccggtcgggacgctgcaccgcgatgacacagaccggcgggttgctgcccgacctcacgattgggcagaccatggagatcatctcctcgctctatcgtggctcccacatgaatgcctgcatggagcgagcaaggatcacgcatctggccgatcggcaggtgtcgatgtgctcgggaggcgagcgccaacgacttcgcttcgcactggctctgctgcccgatcctgacttcctcatcctcgacgagcccactgcggggatggatgtggaggcgcgccgggacttctgggcagagatccacgaggacacgcgtcgtggtcggacaattctgttcgcaacgcactacctcgacgaggtggacgagttcgccgatcgggtcatcctcatcaaggagggccgcgtcatcgccgacgacacctccgacgcgatccgcaccatgtcggggggttgcaccgttacggcgaccattcccgacttctccctggcacgactgaatctgccgggcacccaactcatcaagcagggcggcgcacgcgttgatctgcaccatcccgattccgatgccctcgcagcgcgagtcatccagctcggcggcaccgacctgcgcgtggtcccccgcagcctcgacgacgccttcctcgctctcacctcaaccaccaaggagtcctgacatgaccgcccaagcgcttcccgcagtcgccactcccaaggcccgccaccgatccgccatctcgctgaagtacttgtggtgcgagatgcgtcgccccttccggcgttcgacgatgctgttcaacctcgccctccccgcagttctgtacctggccctgttccgcaccgtccacaccgccgagctgccggacgggaacttcgcgatgtggatgatgatcggcatcgctgtctacggagcggccactgcgagcaccagctacgcagcctccatctccgtcgacgaggccaacgggtggacccgcaccatccgcctgacgccgttgtcgtcggtcgggtacgtgctggtgaaggtcctctgcgccatggccatcgccctggccccgaccctgctcatcggtctcatcgggctgttgaccggagctcacggcacgctgcgggtctgggtaatcggactgggggcggcttggctcagctcagcaatcttctccgccttcggcctggctctcggactgtccctgcgtcccgaggtcgtcatgcacgtccccggcctggtcatcaccggtctggcgttcctgggcaacgtcttcgtccccctcagcgggacgatgctcaccattggccgctggagccccgcctacggcatcaccgcgctggctcgttacccgctcaccaacggcatcgacatcgggggcggccacgactccctgacggctgccctcatcggcaccttctgctggttcgccggattcgtgttctgggcctcccgtcgatttaccaagagcacgggtcgtcagtgacagattcggccgatctccggaaggagcagtgttatgaccaagcccctcattgcagtggtcaccgcgggccaaggagcgcagaagcctcgcctgctcacgccatggctcaaggtccccggcgtcacggagaagcttgctgcatggtccgctcaggccgatgtggacctcgtcgagctcggtaccagggcgaatgcagaaaccttggcagcgaccgagaatgcgcagccactactggtctgtctcggagtcctcgtctcggatctcctggccgaccagaacattgtgctcgcaggacactccgtgggcgagctgacagcagcgtgtctcgccggggtagttgatcccgggacggccgtcactcttgcacgacggcgtggactggccatggcgcgggcctgcgctctccacccgaccaccatggcggccatcattggtgacaatccggatgacgtcctccggcggctctcggaactgggactcacggctgccaacatcaacggaggcggacagattgttgcggccggctccaccgacgcgatcgcggaactggtggcgacccctcccaacgggaccgcagtcaagccgttgcgagttgctggcgcctttcacaccaagtacatgacgcctgcgcaggacgctttcgcccaagctgctcaagacgtcaccttctccgacccgcagcacccgatcatctccaacctcgacgggcaggagatccggtccggcaatgacctgcgtgaacggctgattgcccaggtgaccgcgccagttcgatgggatctctgcatccagcagatcgcggatcgtcagccggaactcgccctatcggcccctccggggaaggtgcaggcgtcgctcttgtctcggcagatcccggacctcgcgacggtctgcatcaccacaccacgggaggcagcccaggctgcacagcggatcgaccagtccgtatccgtccttcagggggcatgatgctcatccccgagtacttcctcacagcctgttcggaccatgctgagcgcctggcgatcatcacccacaatgacgttgtgacgtgggccgaactggcgactcgcgtcgacggttttcggcgctggctgcgggaccatggcgtgcaccgccaggacagggtcgttctccagacgccaagcaccgtaggcacggtagccctcatgtgggcctgcctgctcgacggcgtgacgatggtcccggtgcaccaggacctcactgcctcccaggtgcagcaagtcatcgacgactgccgtccagctctggtgtgtggcagcccggacctcgtccaactcctcaactcccccggaatgaagacaagcacacctccaacgcggccggagtcaacgagtattctgccgtccttgtcccgggtcagccccgatgaccttgcgatgctcatctatacgtccggcacgacgggtctcccgaaggggatcatgtgtccccaccggcaggtcgccaccgccgcacggaccgtccatgactgtctcgggtaccgcacggacgacgtcattctctgtcgcctgccgttgtccttcgactacgggctctatcagattctgatgtctgccatctccggtagcgcggttgtcctgcgggacggaggcgcgcaggaccgcaacctggtgcgcgacatcgcccgtcacggcgtcactgtcgttccagtcgtgccgtccatggcgtcaatgctcatcaccctgcagcgtcgtgatcagttgccgaccatcgtcagactgttcacgaataccggggcgcgtctggcacccgagaccgcgaaccagttgctcgcaagcttccccggctcccgctatgcgtcgatgtatggcatgacggagtgcaagcgcatctccatccttccggtggaggagtacgagacgcatccggacagcgtgggaagagctctgcccagcactcacgtcgagatcgttgacgctcagggagttccggttccggcgggcgagcacggggagatcacggtgtccggcccgaccgtgatgaacggctactggcaggtgccgaacagtcccagtggacgattccgacccagcggccacggcctcactctgttcaccggtgatcgcggctggatggatgaggagggacgtctctacctcctcgggcgcgacgacgagatcgtcaagcatcacggcatccgaatcagcctgcaggagatcgagatagccgccgaagccgcgccgggcgtcgacgcagtcatcgctctcaagccggcctccgactcggcccccattgaaatcgcctactgcggcagcacgagtcccgagaacctggcccgccatctcgaaaccgtcctggaccgggcgcgacgaccccaattcatccaccaactccagcagatccccctgacccgtaacgggaaaccaaaccggtcagcagccgccgaggccatccgctcaagggcgtgacggcgaaggccaacacccacagacgaaaggaaaccaccatgacccaggccgagttcaaccagttcatcgagtccacctgctccgcgacgatcgtggatcccgaccgtcctttggtcgatcagggcatcgactccctcggaatgctcaccctcatggtcgctatcgaggacagcctcggcatcgaactggatcccgagtccctcgccgacggtaggggttccacgccctccggtcttctgtcccttgtcgagcagccgaaagcgacggtgtgacgacatgacgacgatggttccttgccgccgtgtggagatgccgcaactgttcgaccacatccccggaagcatctctctctcaggagggctgcccgatctgagcgtgctcccgagcaatcagatcgccgaactgacgtcccggatcatgcgtctcggctcaagaatcctcctgcaatactccaccccttcggtctcgtcctccttggtgccggccatcctggacctggcggaacgaacatgcatgtcaccggatccgcggaatctgatcccgaccgcgggttcccaactgggcctggccatggtgatcaatgcctttgacggcgatgagatcatctgtgactgcgccacctatcccggggcgctggccgccttcgcctctgccggcgtggaaacaacgggggtggccagtgacgaggaggggctcaacccagacgcgctcgctcacgccgtcgcagagggtcgggccaatggccgccgcatcgcagccgtctacaccacgcccaccttccagaatcccaccggctccgtacagtccgagaaccgccgtgcggccctgctcaaggtgtgtgctgacaatgacctcctcctcatcgaggacgatccgtacggcatgctgtccttcgacgggcagacgtggccagctctgaagtccatggacccacagcgcgtcatctacctgggcaccttctcgaaggtgttcgcaccgggcgtccgttccggctggatcgatccgcccgccaatcttgtcgagaaactccgcgctgtgtgcgagatcatgacactctcgccatcagccctcaaccaagcgatcatcggcgagtaccaccgtcgtcacggatgggacgaactgttggagggctatcgcgcctcctaccgcgaccgagcccgtctcctcatcggggctctcgaggctgaactggcaagaacgaattgcactggcacgtggacctggcgtgaaccacggggcggcttctacctgtggttggagaacgtcgccagcaccagcggtatcgacgttgcgcgtcgcgccgccgacaacggagtggccgtggtgcccgggaaacacttcgacgcagccggacacgattcgccgagcctgcgggtgtcgttcagcaattcacgcccggctgatctggtcgaaggagctcgtcgtctcgcccgtgcactggtgggagaggacgttcagaaatgactctcgcgacacgcaccgccaccgacaccctgcagcagaccttgccctggggcacccacgaacgtctcgtcttcgggcgggcgctcctgcgcagcaccggcttcccagccgaaggcttggccctgctcgactccgacgacatcctccccctcctcgactcctttcttgccggggacatcgacagaactcacttcgagaaggaatacaccagtcgcgaggagtccggcgcaagggcgctcatcaacgtcttgaaggacgatgcagtatcgcgcgccatcgcatggcagaaccccaccgcgtggaggtccttcgaatccctgtcgtccacgagcggaatcaatgcttcgactcggcgcaaggtacgccaactcgccctctactggcaacgttactgttccaaggctgagaccattggatacttcggcccgttcgcctgggccgaagtcgacccggaggcctctgcggtcgaattcatctcctccgaccatctgatcgaccgttcccacgtcgcaatggaggcgtgggcggtcattgagatcgggaaagccctggcatcacgggccgaccttcagtggtggatgccaccaatcctgtcccccgccgtcgacctcaacatggagagaggcaccgtgacggtggctggacaccagccacgacgggtccgggaggacgaggcacgagttctcttcctgaccgacggcacccgtcccgccgcccagatcgccaagagcctcgacatggagcccgagcggttgcgcaggatcctcgtggcccatgaacgtcgtcacaccgtgatctgggacgccaacatccctgtctcagtgcacgcgtgggacatcctgcacgaacgcattgcccagatcggagacgctgggctgcgagatgaggccactgctgttctcacgaggttcgacgagcttctggaggtcatccgcaacattcccgacgcccggtccctgacggaggcgacggaatccctgtcccgtcttttcgaaaccgtgacaggaacctcttcgaacagacgtgcgggccaggcatatgcagcccgcagcctgtgctacctggactgcacccgcgccggaaccgccaaggttgggacccggcttctcgaagccctcgacgcccccctcaacctcgtcctacaatccgctgactggttcgcggcgaccttggcaaaggaatacaccaccgaaatcacggacctcgcaaatcgaaagcagcgggcctcccaccagccactgaccatggctgatgtctggccgtccacgatgtcgctgttctggggggactcaccgtccccactgcagcgagccgtgaccgaactgtcacggcggtggagcagagtcctcgaggggctgcagccagtcgacggtcgcatcgacacgacatcgtccgctctctcgggcgccgtggacgagcagttccccgtgtgcaccccgattccagaactgtcagtgcacagcccggacctccaggtcatcacctcgagcactagcaacatcgcctccggacgagtcactgcagtcatgggtgagctacatgcctgtctgagcagtctcgacatgccgttgctcgagtggtcgctgccccatggttccattcgcgatcgcatcaacaccgcgctcaacctgcgacgtctggttcccttgttccccgagacatggaggcgcaacaccggccgcatggttccagcgacggtcggagtgggggatcgcgcaatcgggttcactcggacggccgatcaagaccgtgcgaacacatggtcgatgtcggcactgctgttcgagcagaccgaggacggactcatgatccgtgatcccgatggcaggctctggaccatcgcacaagcgtggagcgtgcccatctccatggtcgccgccgatgcgttcaagatcgggctgcccggctcaccagcccctcggctcaccattgacaatctcgtcgtgttccgtcgtacctggaggtttcccgctggctccatcgacatcatgcacggttcagccgccgagaaacacgctcggctgagggagtggcaggtcacgaatcaccttcctgaccacctcttcgtcaagttcccctccgaacccaagccgatctacttctccttcgagtcccccgccatggccacggtcttcacgcgatcactgcagcgcgacgcccgagagaatccagacagtctcgtgacgatgtccgaagcactgcccgagcctcaatcctcatggctgcacgacacccggagccaccactacgtccacgaattccggctgcaactgaccaaggagcgacatgacgaccacagttgagacacatcccgaaacacgtggcacaaccgcgacatccatctccaatctgatcggtcacacccctctcgtaagaatggaccatctgttcgacggcctccccttcgaggtgtacggcaagctcgagaagctcaatcctggcggaagcatcaaggatcgagcagcacaatccatgatcgaacgggcaattcgacggggtgagatcgtcccgggccgtacgaccgtcatcgagtccagttcgggaaatctcggcatcgccgtggcgatactgtgccaggagcacggcctgaatttcatctgcgtaaccgatgccaaggccacgccaacgaacattcgactcatcgaagcgttcggggccactgttgaggtgatcgaagaacctcatcccgagagtggcgaattcctccccatgaggctcaagagggtaagagaactgctgtcagagattccagatgcatggtggccgaatcagtacgggaaccccgacaatccggcggctcacgagcggactgtccgcgagatcatcgaggcaatcccgcgggttgacacgattgtctgcgcgaccggctcgtgcggaacccttcgcggctgccacgaagcattgcgaaagctgtccccacgcacccgactcgtcgccgtggacgccaagggcagcgccatcttcgacgaggcaggagcaccccatccccgctgtgtcccgggacacggtgcgtcagtgcgaccgccgctgtggcgcgcggggctcgccgaccaactggttctggtctccgacgcggactgcgtcgtgggatgccaggaggccctgcgcaccgaggctcttctcctcggcggatcctcgggagcaattctgacggccattcaccgagtgtctcccacgattcccgctggttccaccgtggtgacgatcctccccgacggcggcgagcgctacatcgacaccatctacagccgctcgtgggtcgactcacacatccccgggctgccctctctcgccgactggggggctcccaaccccgccaattcgtatgacctgaacagaagtgcctcatgaagctctacaccagagagaccgtcgaaactgcgcttgtcgggcgtcatggccaggttctcagtgccgtacagagtgcatacatgctgcattcgacgggagagacatcgctgccattctcaaccttcctccgcccggccgggtatccgaacgatcggatcatcgcacttcccgcccacatcggaggcgacttcgacatagccggtatcaagtggatctcatccttcccggaaaacctcgaccggggccagcaacgagcttcctccgtactcatcctcaatagtctggagacgggatacccgaccgccctgctggagtccagtcagatttcagcaacgcgaacggcagcatcagccgccctggccagcgccaccctccatggctccgaagaccatgtcagcacgattggcatcatcggctgcggaacaatcaatcttgcaacgatcgactacctcttccacgtgcacccccagatcaacgaggtcctctccttcgatctgaggcgggagcgggcccatgagttctcgcacctcgtcaaggcttcgcacccagaggcccgggtccgtgtcgccaaggagcccgacgagattctggccgcaagcaacaccatcgcgatcgccacgaccgactcgagtcattggttggaccttccgccgtggcacgggccggggcaccaagtcgtcctgcacacgtcgctgcgagacctgtcagtgccctcgatcctggcagcggccaacgtcgttgacgatcctgatcacgtctgccgtgaagcgacgtccttggatctggcaactcagcagaccggcaaccgggacttcatcacggggagaatcggagacctccttcttggcgcgccgctgtcctcaagtcctgactcccgtgtcattttctcacccttcgggctcggcatcctcgacctcgcagtcgcctccgtcgtcattgctgccgcctcctcttcagcagtcgagatcaatgggttcgaccccgggaaacacgccacaagcatgattgaggtgaatcgatgaccaccacacagatcaacgacaacacggccgttctgcgcgacgtattccccgccggctccgtcgcattcgtgagcggtgcctcacgcggaattggcgctgcctgcgcgacagcccttgcggccgcgggatgcaacctcgccatcacttatcgaaggaaggagaacgaggcggcacaaatcgccgaatccattgaagccatcgggcgccagtgcatcacaatgcagatggacgtaaccgatgagaaccaagtgaccagagccttccgcatcattcgccagcattacggacgcctggacgccgcggtcttgaactcgggaatcaccagtgacgggcatcttgcaacaatgagccgctccaagtggagctcggtgatcgacacgaatctgaccggaaccttcctctgcacgcgcgaggcgaccaaggccatgtactcgtccggtggctcgatcgtcatggtcgcgtccaccagtggagttgcagggcgaccgggccaggccaactacgcagccagcaagggcggaatcgttgccatgatgaagacgctggccccggaggttgcggcaaagaacgtccgggtgaatgcggtggcacccggcttcattcagaccgacatggtggcggccgttccaaaagcggcactcgcccaggcaatccaacacatccccatgggccgtcttggcctggcacaggaggttgcgtcagccgttaccttcctggcctccccgctcgccgcctacatcacagggaagaccctcactatcgatggcggaatgatcaacggctgaccccaggacccgcacacccccagtaccgagaaagaaacaacaatgaccgagatcacccacactgccaacagcatccgaacccgcgccgaggaacgttccaacaaagcttggcgcctgaaggaggagatcatctccaagctcggtctcgagaccaagccagaatatgtctcggacaaccaaccgctcttcggacgtggccttgagatggattcccttgacactctcgaagtcgtcgtcgccgtcaacaatgagttcggagtctcggtcaacgacgacgacgtacaggcgttcggctcgatcaatgccatggtcgatttcatcgaggtgaacgagaagtgagttctcttgcgctcgaggcgccacccaaggacgcccgtaagaaattcgcctacgacagcgatgccatcaagacgatgctcccacatcgttggccgatgctcatgattgatcgcgcctacgacgtcgtcccagggaaatcgggcaaaggcatcaagtcggtcagcgtcaatgagccgttcttcgccggtcactaccctgaccattccatcatgcccggcgtcatgatcgtcgagtcgatggctcaactcgtggccgtcatctacgtagccgaggccattcagaacaatcccggcatgacgtcgcacgacgcacgttcaagcgttggttatctcggcgcgatccgtcagatgaagttccgacgcctcgtcactccgggcgaccaactcaccctccacgcccagctcggcgagaaagtgggggctctgcgcgaggtttccgtgagagcactcaatggccgggatgtcgtcgcccagggggaactcgtcgtcaccgagcggtgacacccagccacacacgagaaggaagtcccatgatcgttcgcccctacaggccacgtgatgcggaagcgatcgtacatctctacaacagccattccgactcccccaatccagtgtcgggagggattgttgaggaggagttccagagggagctcgaagaacgtggttcgacagtgttcctagtggccgaggaggccggatccattgtcggcacattcgggatgttccgcacgaatggccgacacaccatggccgatgatgaagtcttcgccgacatgttctatgtcaccccgtcacatcgactctcgacagttccgggacagctaatcactgaagccatcagcgagtgcttcatccagggcatcaacgtgatccgcctcaccgtgaaccccgcgaacatctccgcgctcaaggtttacagaaaagtcggttgtgcctgtctcggggccaccgatgcaggcgaggacgggaacattgagctgtacaacttcatccctctggttcttagggcaaccatcaccaaactcgaccacgattgtattcgagccctggcggacatgacttcgttcgcctgcatcaccgagggacgtccacttgatctgtcccacgacttcatcgtggacgctggacggaagatcgtctcccacagcatccagatcgggcgttcaaccatccacgccatggtcgacacgggctcgaggaccattgtggaggccaccctcgacaaccgcgactgggatgctcctcgccagatcgtcgcccccaccccctgtcagaaccggcccgaggaacagcgaggcaaccctgtccggctggtgcacaagaagcttgaggtcaccttcaacgaaggagtcattgagatcagtacgactggccactggggcccggtcctcgcaatgtcctggccctcctccgtctcgcaccgcgctcacgggtggcgacagggccccgccaagtcgtatcgatgcgagcttctcgagaattgcctcgtcctggatgacgaaggaggagtgaaatgcaccatcagcctcaatgattgccaagtcgcgatccggatggatggtgccccaaaaacggaattgagaatgtaccagtggtgcagcctgcgccagggctatctgacggctgacaccggcatcacgagcttcaaccgggcatccagtgggctcggagtcgccgtccgggactcgtccgagattgtcgccgcgggccttcccgtcatccctgacacaccgatcacatggagtgagggtgacatcacggttcagctcgatccctgcggccgcgcctccctgatccactcgaccctggtggaccgaagaatccacttggacgagtctggctcggcaagtctcaccatgaccgtgtttggtgattcccagccccatcgtgccgacaccgtcgagctgcctcccctcgcggcaggcaccgacaggatcgtcctcaagccggctgccggaggcgtgaccacatggcgcttgggcgccaccaaggtgctcaagtcaccgtggccacacgcccgcgcgctcgggcccaatccgatctggcgagccggcctgtgggtcagtcacgagccggatcgccacgaccgtcgccaaggaatggggtggggtcccgatcatcgcagttggaccctgtcggaagacaccatgaccagtactgacgggacactctcctggcgcttcagcggctcccccgacaccggctggacggtcgacgtcacgacgagcaacacgcacggggagaccgtcgtctggctcaccccggactgcccggcgggcgagaggatccgcacgtctgatcatgccgtgacgaccatgcttgacatctcgaagccatggcagcgctggaccacccgatgcgcaattcctctcagacacgggaagtggttcctcatcgagcctgatcatgacctcactgattcccccgaaatcctcatgcgctctgttcacggggtcctgctcgtcggctgtgtcggacgagcccactccggatccgcttcctggcgctttgccatcacgtcagaactccccacctccaacccaagaagaaacgactacacctcagccgcctgaacccaaccagttggaacacccactacagaagaaatggagcaccaccatgtccatcactgagcagtacaagacccttcgcacctcggtcggcctccacacgcctaccggtcccctggtccgtatcaccggtgatgatcgtctcgagtttctcgacaccttcctgtcccgcgcctcggacttcgtggaccccgacaccactcgggagtgcctcgctctcaccgaggacggccttccgctgacgatcttcctccacatcgagcgcgaggaggagtcatggctccttccccgcaccgccatcgatgcggcgaccctcgccacgtacctcggcaacctcgagaccgatggtgacctgtcaatcgagattgctccagagggttggggagctgtcgctgtcgaggggccgctgtcgtggcagatcgccgaaaaccttctcgacttcgacgtggctggcctcgttcttcacgccgtcacggacgtcgtcgttcccggggcccccgagggatcgaaggcatggctcgcccgggtcggaaccactggagagtacggctacctgctcgtctccaacgttcccgacctcgcccgcacttatctcctcagccgcgccacggagctgggcggtcaggcagtcgacgccgatgctctcgcacgagtccaggccgaggccgggatgccctattacgcgatgggcgtgtgccacctcgatgtcgccgggggtgacctcgcctggctcgtggactggcagcgcatcggcgagttccaaggatccgagaatctgcccacacccgtccgagaccagcgccgactggccgccatcgccctgcccaccggcaaccgcccggaagctggtcagaccgtcgctgccggggatgaggagattggaatggtggtgtacgtcaccccgtccgccaatcccgatgaggaactcgcgttcgcacttctggatgctcctttctggactcccacccttccgttgaccgtcggtgcccacgacgggaccacggtcaccctgccccgcgtcgtggcagcctccagcctcaacaagctggggtgacagcgatgacgatcactgctgagaacgccaccacccgcagcgacattgcccggagcattgcggtgaccggcgtgggactggtcacggcacagggtgaccataccgacgagtgctggaccgaacttgtcgatggggtttgcggaatcaccatgaacgtcacgttcgatgactctggcaccacgattccgtgtgctggcgtggctcccattccgaactctgattcgatcgaccgctgttacctgctcggcgtccatgccatgcgtgaagctctcgagatgagtggcatcgacctggactccgtgggtcgtgatcgcatcggactcgtggtgggctcaagcctcggcgcgatgcccaccttggaggcggctcatcgccgggccattgagaccggcgtgctcgatgccggattggcggcagactcccagctccactgcgtcgccgaccacctcgccgctgagttcgacatccgtggaccccgcgtcgtgacatcgaatgcgtgtgccgctggtgccgtggcgatcggctacgccgcagaactcctctggtccgacgatgtggacctggtcgtctgtggcggtgtcgatccactggcccagatctctgccaatgggttcacgtgcctgggagctctcgacaatctcccatgcagcccgatggccggttcctccggtctgactctgggcgagggagccgggttcatggtcctcgagagaacagatgcggcggctgccagaggccaggaggtgatggccgaaatcgccggctacggcacaagttgtgatggttaccaccagactgccccggacccgggtggcaatggcgcccgcagctcaatggaggccgccctgcgctcagctcatctcaagccgtccgacgtcagctacgtcaatctccacggcaccggtactccgaccaacgacgccgtcgagccgaaggcactccggtcattgttcaagtccgatgaccttccccctgtcagttcggtgaagggcgccatcggtcacactctcggcgctgctggcgccatcgaggccgtgtgctcgatcaaggccatccacgagggggtcctgccgccaaccgtcaacaaccgcgggcaggcttcccgaactggtctcgacatcgtgccggagtgcgcacgcaaggccgctcccgacgtggtcatctccaactccttcgccttcgggggcaacaacgcatcagtggtcatcaccgcacctcgaggaggcgttcactgtaccgccccggcgcagcttcgcgaggtcggaatctcaggaatggcagctctggcgggaaaggccgccaactcggaggagcttctttcggccctgtcagaagattgtccaatctggatggccgatgagaagacctgggaaggggatgctgtccaaaccggccatgtggacatcaagcgcctgtcccgcacaatcaacccgtccaaggttcgtcggatggaccccttgggaatcatctccagcgcggtggtgactgatctgtatgcccgacacgggaagctgagccgcaaggatgccgaaagcacgggaatcatcttcgcaaccggctacggtcctgtgacggcggtgacgcagttcaatgacgggatcatccgccacggttccgagggtgccaacgccctggtgttcccgaacaccgtggtcaacgcagccgcaggccacctcgcgatgctgaatcgctaccgtggttacacggccaccttggcatgcggtggaaccagttcactcatggcgctgcttctcgctgctcgcgtcgttggccgcggcgctgcggatcgcatcatggtcgttatcgctgacgagtttcccagcattgccgtccaggccgtcgcgaagcttcctggctaccgacacagggttgatggttccggagccgtgctctcggaaggcgcggtatgcgtcctggtggaggccgtcgaagtcgccgaagcacgcggtaccgcccccatggcgctgctacgcggcttcggatcccgtggagagtccgtgggagtcggtcacaccgcatccgatggacgggcttgggccaaggccatggccgctgcactgggcccggccggcctgactgcctccgacgtgtcgaccgtcgtggcggcatcaagcggacatcctcgcgtcgaccgagccgagcaggcggccaggcggatcgtcggactgtccgcaaccgctacgaccttcccaaaggcgattgtcggagaaacacacggatcggctgccgggatcgggctgttcggtgccctgtgcggttcgaggtcagccgcgcaccagaacatccttgtcaacgccttttcccacggcggtggttatgcctcgatggtggtggagtcactgtgaccacgacgcttctgccacgggttgcccagccgggaccgggcgtcagccatgtcgacaccgaccgtcccatcgagtgcatcatcacccaccacccccacatgccgcgtgatcgcggaggccacgccacctccgtgtcaggcaggtacttgctgcgccaagccgcagaactcatgctcggcacggatcctgcgcattgccccgtcgtcgacccttcgcggcgctggtactggcccggaatcaatcttcacggttctgtctcccatgtcccgggctggagcctgacgacgctgagcaccggcggccacatcggggcagacatccaggacttccgggagcgtcccggcgcaatggcattcatcggtgacctggtcaagctgtcgcgatcggcgtcactccgagaattcgcggagtgcgaggccgtcgtcaaggtgtccgaattgactaaggagacgttcgggcacgtgcgactgcccgaatggacacccggatggcgccacgttttcgaggactactgggtctggagtctcgagatgcacgggatgggagtcatcgcactcgcatccgatctcccccgagccattcgctggtggcggtgcgacgccgatgcccgtggccgtctccaggctctccgacccataagcagtcttggaccaggaaggccgtcatgagccggtactcacgtcgaatctcaggcatcgaacgcggctatctcaacgccgcaacccggggcccgcaccccaccatccacacgatgatcgacttcgagggccgcgtccccgccgactgttggcggcacgcatccacgattgcgtcggccgccaaccctggcatgacagtggtccggaggtcgggccgatggacatccgatccagcgggctgtccggttgtgttccacgactggaccgcggaccccaacgacgttgccgacttccacgctgacatggatctcgtgacgggaccatcgtccacgctccacgttttcgagggggcggaacgcacccgaatcaccttggcagcaagccatgccgtgaccgatgggcggggcatcgaacgatttctcgtcgacctgcttgcagcgttggacgagcgtgaacccattggaagccccgacaccctgaccgatgtcgatatcaaacgatccttggagaacagcatcaagccccgacgccacctggccgctgtgcccgccgatgtcctttctccactgggggggaggaagaaccaacgtatatgggcctccaggacgtggcacagtgccccgggagccatgagcggaagaatcgctgccgctgtggccgagatgatcgaccacgccgcaatgatcatcatcccggttgacatccggcggcacgtcccagaggtccgatccacagcaaacctaagtgcccaactgccagtgatcatcaccccgaaccagcgctggcaaagcatccatgggcatctgctcacggaccttgctcgccatcgagaccttgcgatcatcagtgaggatttccgccacaacaatccgttcgcatcgaccttggaggaaagccaggccatcggcctcgatggtgtctatccctgtgccgcaatcatctccgaccacgggaagctcgacctttcaaggttccagaccttggaactcaccccggtctcgatgcgaagcctcccgatgctcgttccctactccgcaatgttcatcagcagttgcaccgtcggcgagaccaccactgtcaccatcgctcatcgcgctgatgacgatcccgattccataaacaccttcttccaccacatcgaatcccagatgtccatctgagccacgtcgtccctggagagcaaacatgaccacccaaaatgtcatcaccccgccgcgccccgtcacctcccatgccacggcgaccaggtccgaggctccaccgcgaagcgtcatcagagccatggccatctcgatggtcgcgaccctcatggtcatgctcgacacgaccgtcgtgaacgtgtccttgagcgcgaccaccgcccgcttcgggagcatgggcagcgtgcagtgggtcctcacaagttacctacttgcactgtgcgcgacgatgacggcctccgcctgggtcatcgaccgccttggtccacggctcaccttcatcgcctcaatgaccatgttcctcatcggctcggtgatgtgtgcactgagcgattcagtgtggcaactcgtcactggcaggaccatctccggtgccggagctgggatccttgttccgacagcatccgtcctgcttatccgtggcatcccacgcgaacaacttggcagggtgcaggcactgaatgggagtgtccagttgatcgctcccctgatcggcccgactgtgggcggtctcctcgttgacaggtgcgggggctggccggccatctactgggcgaacgtccccgtagctcttgttcttctgattgaggccgtccgcgtcgatccggacgaaccacacaccgctaagcgccgcctcgatgctctcggcctggtctgtggcagcaccgcgatcgtgctgacagtgcttggtgtctcactcttcggcaggacgtcgcgaaacaccaccttcctgcttacgatcggcgcgcttgcagtcctcgcatgggcgttcttcatcacccacatccgaagggctaccaaccctctgcttgacgtttccctgtatcagaaccctgtctattcatggtccagcttcaacgtagcggtgcttggtttcggtctctacgcccccatggtcgtcatgcccctctatctcgaggcgacgcgccacctcactgccgtccacactggtctggtgatgtcagtggccggcgtcggcgtcattatggccggaatcctgtgcacgaagatcatgggccggatcggtggaggcctcacgatgacagttggcataactctgagcatcatcgccactctgcccctggtccggctgacgaaccacacctcctacatactcctggcagtctgcttggccttgcgtggagcaggaatcagcctgacaatcgtcccagccatgacacgggccttcgagtccatcaagaggacggccatggcggacgcctctgcacagctcaacctgttgcagcgaatcggcgggacaattgcgacagcagtcatcatcgcagttatccaccacgaggccatgctcacccgcggactctcccccacagtgttctcgcacgccaacgtgtggatcctcaccgcgaccgccgtcacccttctgccggccttcgcgcttgcgaaggccgaaagacaacagcaggatctctgagcaccgaggagtactccctcgtagaccctcctctgatctaattgggttcgttccaagtgtgtatctcactccggggagccccgattgctgaaccacatcccgttcaccctggcgagtccctcgtggtacgacgtcccctgggcgcccggatctccgtatctcacaggagatatctcggtcctgccagcggactcgccaaggtggacgacgaccatccggggtccttggcaaatccacatgccacctcgtccgacccttccagaggtggggtggaaagtgcatgtgtctgccaagccatcggaattggaatcggttgcctcagtcgtagcactgtggtgcgtacgccacagcgtccccttcaaagtacttcgcacccgaggtctcgttcacgcgagtcaagtcaagtatgcggaccgaagtcagagcggcaaggtctgcacctgctaccccgacggcgagagccttgagcacttctgctccggtcttgccgagctgcttcagaacgtcgattcacctccggtgtccggcgagctgcgagtcggatcctcccctctgtggttgcgtcacgggagtttccgagaggcatgggcggtgtcatccacaggagtaccgttcccggtctacccgggaacaacacatcctgatcgtcgaggccccgcgcccgcagaatccgatcacgacacgccgtggatccggaggctccgtcggacgaatcgccccagcacggttcttcccatcgacgatgtcagactcctccaccgatcaaatgctggcggcgtgtatcaggcaacatggagagacggcacatcggtagtcgtcaaggaggcccggcacctgtccggacttgatgcggcgggtgtcgacgcccgagtgcggctgcgtcacgagtacgaggccctgagaagactggacccctatcgggccgctccccatcccattgatctcattgagaccgaggacggctcgttcctgatcatggaattccttgacggaatgacagtccaccaggagatgtcgaggttccatcctctgattagtaggcgacctcatcggctatcgatgaccgatttttcacgctggtgccgagaggtcgaagatcgcttgaggaatgtcacgagggtcatggccgggtgcggaatcgttcacggggatcttcatcccgcgaatctgatacatgtcggccatgaggttttggttactgactttgaatcctgctcaatcgacggggtcgccgtctcgtcagggatcgccgctccctggttccagtcggacgacacgattcccgatccggcgacgactgacgatctccacactcttctcgtggatccgacttgcggccccgcgcttgtcccccatccaaatcttcgcgcgctcatcagccaggccgcagtcgaggacatgatgggaaatccgactagtttaccacatgcctggaacctcgaggacatgacaagcgaactcgccaaggggatccgggcatcagccactcccgcacgagccgaccgcctctttccctcagacccctacctgttcgggcatccaggttcagaattcggcctgatgcatggcgccgccggaatcatggctgctcttgccgtgactgggtacggtgttgacgcgaatcacgtgacctggatgaaggaccgcttggccacccgcccgaccctgctgccggggttggccaacggaatcgagggaattgccctgggtctctccctgtgcggtcagaacgacatggctgcatccctgctccaccagtccggaattctcacgatcacaacgaacggatcgactgacctcaccctcggtactggtatggcgggccgagcgtgcgcgctgcagtccctctcacaacgactgtcatcgaaatctctcgcccacgctgcatataccctctgggaacaactcgccgtggctgtgcggaacactgatgtggccttgccgaacggcctgttctccggttgggagggaatcgggctctccctgcttgcctctcccctgccggatcgtcatgatctcgcccgccactcactccgactggccctggccacgacaacgattgttgacggtgcgctcttctcaggcgagggacagatccgatggccatatctggggcgtggtcccgcggcatgtggcccgctcgccgccaggcttgatgatgaccagacggccaaggccgtggcacagacctgtcgttgtcccctgactgagtcatccggtctccacaatggccgcgcaggtctcctactcgtcctccgccagctcgtgggagaccaagacgacgccgttcgccgccacctcatgagactgtcgtggtcgatggaccgtcgcgaggaaggcacattgctgctgggtgatcatggcctgcgtttctcatccgatctcgcgacggggtcagccggcgccctcctcgccctgagcagggacccatggcggaacatgacacgaatgctcggaatatgcgatgacacctgtcatggcccactagtgacagtttgatctagcgccgatagttcacaactgaaagactccaaacatcgaggaaaacatgctgagccaaaacgccttggcaggcgtggctcgtttcaccacgatgaacaccaggagacagaatgtccgttgaggccatgcaatccatcgagatggacgaggaaaacagcgccagccagacagtttgcgcttgttacagcttcttctcgtggtcaggatgctgcgtagtctcccaagcggtggaagcatcttgatcgtgtgagacgccgtcgactaccctgtcccccgtggtacgcacacgccccgtcctggacagtcccggaagaccgctcatcgcctccggagtcgtcctggcggtcctgctcatcatcgcggtgatgacgatggtgcttcagcgcgaccccactctcacccccggacgccgcattctcggtatcgtcctgtccacggtccaggccgtcggattcatgtggctgcagacccgcatggttcgtcacggcaagggttcgcgcaacatgcgtgcgacccttggaagggtcggtttctgggccacgtggggactcgtcgcagtgggagtcgtcaatctgtggctgaccaactcgtggaccctcttcggggcctccgtcgccacgcccctccttctcctgccaggggtgtggagtgtggtggccaccctcgtgaccctgatcgtcggtttctccgacctcgtggtcacccacacctcgccactgacctcagccacggtcgtgctggtgaccatcgcggtgtcggtgaacctctacgcattcacgaagctgtcgacggcactcgttgaactccgctcctcccaggaggagatcgcccggctgcgcgtggacgccgagcgtcaccggatatcgcgggacctccacgacatcatcggtcgcaccctggtcgccacgtcgatgcgccagcaggcggccctccacctcgtcgaccgcgacccgcaacgggccaaggaacagctcgacgccgcccatgacgcaatcaccgaggggcagcaccagttgcgttccatcatccaggccgagatgagcaccagcctccccgacgagatcagcgacgccacattcctgtgcgaccgactccacatcgacttccgcatggatgaccgcggcagaccgcacaaacccttcgactcggcggcggcggcggccctgcgcgagggaatcacgaacatgctcaagcacagcgcggcgggctactgccacgtcgccatctccccggacctcctgaccgtcaccaacgacggttgtccgcaatcacctcgcccctccaccacaccgggcaccggaatcgaccatctccggtcccagatcgaggcgctcggtgggtcggtgacgacgtcgcggccctcgcggggcaccttccggctccgctgctccttcccgacccggggggcgtccacgaccacacccgcgaccgaaggaggacgatgacgacgagaatcctcctcgccgaggacatcaaactggtggcagaggccttcgaggcactgctctcggtggaaccggagttcgaggtcgtcgcacgggtggcacgcggcgacgacctggtcacatccgccacccgcctgttccccgacgtgatcctggccgacatcgacatgcccgggatgaccggcatcgaggccacccgaatgcttcgcgacaagggataccgcggcagaatcatcctgctcaccgccctgccgggaagcgggcacctgcacgccgcgatggctgccggagccgacgggtacctgctcaagtcgatcaccgcgccctccctcatcaacgccatccgggcggtgtgcaacggccagtcggccatcgacccgaacgtcgccgcggtcgccatgcgcaagggaccctcgcccctcaacgaccgggaaaccgagattctgcgcctagtcgccgacggttcctccaccgcgcagatcgcctcgcggctgtacctcagcaagggcaccgtcaggaactacctgtcgacggcgatgtcgaagctcgacgccgactcacgcacagcggcggtcacgcgggcacgcgaggagggctggctgtagcaggcgacccgctcagcccaccgcccctcagcccgccgactcctgacgcacggcctcctcgaccgcccggctgagcagggacccggccctgaccatcgacgtctccgggtccggctcgagatcggacaacgcgatgatccggtcgaacgcggaccgtttctcctcgggcaggtcacagcgtccgcacaccgcccagacgggcaccccggcgtcccgggcgatcttgcggatggtgtcgggaagcttgccgagcagggtctgctggtccagccgcccctcccccgtgacgacgagactggaggcggagatccgcgacaccgcgcgggaccatcccaggacgaccgccgcgcccgggcggtacctggtccccaggcacatcagcgcccagccgacccggctgggcggctgcgaaccccctggccaccgcccggcaggcctttcccgaactcagcgaccccttgaaggagtcgacggcaacgatgaccggcgcattcggatcaggacgcatgggatcagcatgtcacgtcgatacggagcagtcgcgccgcctacccctagactcgggggcatggtcaaccgagtctacctgtccctgagcgttctcgccctcgtgctgtgggtggtcgcctaccgtcacatgccgggctgggccgcgggcatcaccctggtgggcatcgtcgtgctgtcgctgtggtgcgagtggtcgcgggtgcgcaccctggccaggatcggcaagtcccgccagcagggcccccgctcctcccgaggacgcaacctgtcgtgagcaatacgattcccgcagccctccaccccggccctgacgaggcc

SEQ ID NO: 425 - DNA, 26620 bp, Propionibacterium acnes
ccttgtggacaccacgtcatccacatgacttgtgtcacatgattcccggaccatcatcaagcagatgctcacccaactgtaatgatttctgttctgaatctggacatgctctgacctgcattcaatgatcaattccgtgcgatattccacaacgcacggggaggtcgcagacaatgacaacagaaagcatccccacgcggctgctcgtgtggcacgagcagaccgatccgaccaagctcctcaggatcaccgacgcgatcaggaggggggatccccttccccccatcgaggccatggcgatcggccacagattcctcgtcctcgacggtgcgcaccgggcccaagcccaccagtactgccatcgatctgagatccgagcccgcctccacaacctccccctcagcgcggaaataccaggctggagccactccataccccgcgatgcagcagcgaaactggctcacctactcctccccgtggacgctctcggtcaggcggaaatcgtcctgcacggggtgcgccgtcaggtggggaccgcttcacaacgaccgcgcgacatctttctcgcctgccaccggatcgcgcgagttgcctacgcgcatggaatcagacctctcggcccggagttctccaacgctccgacgatcgacgccgccaccatgacctggcgcccgccgaacgtgggcacgttgtgggccatcgccagcagtctcggacccctgcccgcaactgtgacccggttcgccccgatcctccggcacgacgccatcggggattccgcgatgacacccgtcacctccgccgcgtgacgacccgcgccaattccgccccaccactggatgaggggcagccgcgtggacgatgctcctgttcaggcagggactccatacgagaccaataggaaaatcatgatcaaaaacacaagccctctgaccgtgaaaaatgtctcgaaaacattccgtggctccagcggagaagccatcaaggccgtgcaagacgtgtcattcaccgttgagcgtggtgaggttgtggcattcctcggcccgaacggcgccgggaagtccaccaccatcgacatggctctcggcctcacccgccccgacagcggccagatcgaggtcttcggtactgacccgctcagcgcggcccggtcgggacgctgcaccgcgatgacacagaccggcgggttgctgcccgacctcacgattgggcagaccatggagatcatctcctcgctctatcgtggctcccacatgaatgcctgcatggagcgagcaaggatcacgcatctggccgatcggcaggtgtcgatgtgctcgggaggcgagcgccaacgacttcgcttcgcactggctctgctgcccgatcctgacttcctcatcctcgacgagcccactgcggggatggatgtggaggcgcgccgggacttctgggcagagatccacgaggacacgcgtcgtggtcggacaattctgttcgcaacgcactacctcgacgaggtggacgagttcgccgatcgggtcatcctcatcaaggagggccgcgtcatcgccgacgacacctccgacgcgatccgcaccatgtcggggggttgcaccgttacggcgaccattcccgacttctccctggcacgactgaatctgccgggcacccaactcatcaagcagggcggcgcacgcgttgatctgcaccatcccgattccgatgccctcgcagcgcgagtcatccagctcggcggcaccgacctgcgcgtggtcccccgcagcctcgacgacgccttcctcgctctcacctcaaccaccaaggagtcctgacatgaccgcccaagcgcttcccgcagtcgccactcccaaggcccgccaccgatccgccatctcgctgaagtacttgtggtgcgagatgcgtcgccccttccggcgttcgacgatgctgttcaacctcgccctccccgcagttctgtacctggccctgttccgcaccgtccacaccgccgagctgccggacgggaacttcgcgatgtggatgatgatcggcatcgctgtctacggagcggccactgcgagcaccagctacgcagcctccatctccgtcgacgaggccaacgggtggacccgcaccatccgcctgacgccgttgtcgtcggtcgggtacgtgctggtgaaggtcctctgcgccatggccatcgccctggccccgaccctgctcatcggtctcatcgggctgttgaccggagctcacggcacgctgcgggtctgggtaatcggactgggggcggcttggctcagctcagcaatcttctccgccttcggcctggctctcggactgtccctgcgtcccgaggtcgtcatgcacgtccccggcctggtcatcaccggtctggcgttcctgggcaacgtcttcgtccccctcagcgggacgatgctcaccattggccgctggagccccgcctacggcatcaccgcgctggctcgttacccgctcaccaacggcatcgacatcgggggcggccacgactccctgacggctgccctcatcggcaccttctgctggttcgccggattcgtgttctgggcctcccgtcgatttaccaagagcacgggtcgtcagtgacagattcggccgatctccggaaggagcagtgttatgaccaagcccctcattgcagtggtcaccgcgggccaaggagcgcagaagcctcgcctgctcacgccatggctcaaggtccccggcgtcacggagaagcttgctgcatggtccgctcaggccgatgtggacctcgtcgagctcggtaccagggcgaatgcagaaaccttggcagcgaccgagaatgcgcagccactactggtctgtctcggagtcctcgtctcggatctcctggccgaccagaacattgtgctcgcaggacactccgtgggcgagctgacagcagcgtgtctcgccggggtagttgatcccgggacggccgtcactcttgcacgacggcgtggactggccatggcgcgggcctgcgctctccacccgaccaccatggcggccatcattggtgacaatccggatgacgtcctccggcggctctcggaactgggactcacggctgccaacatcaacggaggcggacagattgttgcggccggctccaccgacgcgatcgcggaactggtggcgacccctcccaacgggaccgcagtcaagccgttgcgagttgctggcgcctttcacaccaagtacatgacgcctgcgcaggacgctttcgcccaagctgctcaagacgtcaccttctccgacccgcagcacccgatcatctccaacctcgacgggcaggagatccggtccggcaatgacctgcgtgaacggctgattgcccaggtgaccgcgccagttcgatgggatctctgcatccagcagatcgcggatcgtcagccggaactcgccctatcggcccctccggggaaggtgcaggcgtcgctcttgtctcggcagatcccggacctcgcgacggtctgcatcaccacaccacgggaggcagcccaggctgcacagcggatcgaccagtccgtatccgtccttcagggggcatgatgctcatccccgagtacttcctcacagcctgttcggaccatgctgagcgcctggcgatcatcacccacaatgacgttgtgacgtgggccgaactggcgactcgcgtcgacggttttcggcgctggctgcgggaccatggcgtgcaccgccaggacagggtcgttctccagacgccaagcaccgtaggcacggtagccctcatgtgggcctgcctgctcgacggcgtgacgatggtcccggtgcaccaggacctcactgcctcccaggtgcagcaagtcatcgacgactgccgtccagctctggtgtgtggcagcccggacctcgtccaactcctcaactcccccggaatgaagacaagcacacctccaacgcggccggagtcaacgagtattctgccgtccttgtcccgggtcagccccgatgaccttgcgatgctcatctatacgtccggcacgacgggtctcccgaaggggatcatgtgtccccaccggcaggtcgccaccgccgcacggatcgtccatgactgtctcgggtaccgcacggacgacgtcattctctgtcgcctgccgttgtccttcgactacgggctctatcagattctgatgtctgccatctccggtagcgcggttgtcctgcgggacggaggcgcgcaggaccgcaacctggtgcgcgacatcgcccgtcacggcgtcactgtcgttccagtcgtgccgtccatggcgtcaatgctcatcaccctgcagcgtcgtgatcagttgccgaccatcgtcagactgttcacgaataccggggcgcgtctggcacccgagaccgcgaaccagttgctcgcaagcttccccggctcccgctatgcgtcgatgtatggcatgacggagtgcaagcgcatctccatccttccggtggaggagtacgagacgcatccggacagcgtgggaagagctctgcccagcactcacgtcgagatcgttgacgctcagggagttccggttccggcgggcgagcacggggagatcacggtgtccggcccgaccgtgatgaacggctactggcaggtgccgaacagtcccagtggacgattccgacccagcggccacggcctcactctgttcaccggtgatcgcggctggatggatgaggagggacgtctctacctcctcgggcgcgacgacgagatcgtcaagcatcacggcatccgaatcagcctgcaggagatcgagatagccgccgaagccgcgccgggcgtcgacgcagtcatcgctctcaagccggcctccgactcggcccccattgaaatcgcctactgcggcagcacgagtcccgagaacctggcccgccatctcgaaaccgtcctggaccgggcgcgacgaccccaattcatccaccaactccagcagatccccctgacccgtaacgggaaaccaaaccggtcagcagccgccgaggccatccgctcaagggcgtgacggcgaaggccaacacccacagacgaaaggaaaccaccatgacccaggccgagttcaaccagttcatcgagtccacctgctccgcgacgatcgtggatcccgaccgtcctttggtcgatcagggcatcgactccctcggaatgctcaccctcatggtcgctatcgaggacagcctcggcatcgaactggatcccgagtccctcgccgacggtaggggttccacgccctccggtcttctgtcccttgtcgagcagccgaaagcgacggtgtgacgacatgacgacgatggttccttgccgccgtgtggagatgccgcaactgttcgaccacatccccggaagcatctctctctcaggagggctgcccgatctgagcgtgctcccgagcaatcagatcgccgaactgacgtcccggatcatgcgtctcggctcaagaatcctcctgcaatactccaccccttcggtctcgtcctccttggtgccggccatcctggacctggcggaacgaacatgcatgtcaccggatccgcggaatctgatcccgaccgcgggttcccaactgggcctggccatggtgatcaatgcctttgacggcgatgagatcatctgtgactgcgccacctatcccggggcgctggccgccttcgcctctgccggcgtggaaacaacgggggtggccagtgacgaggaggggctcaacccagacgcgctcgctcacgccgtcgcagagggtcgggccaatggccgccgcatcgcagccgtctacaccacgcccaccttccagaatcccaccggctccgtacagtccgagaaccgccgtgcggccctgctcaaggtgtgtgctgacaatgacctcctcctcatcgaggacgatccgtacggcatgctgtccttcgacgggcagacgtggccagctctgaagtccatggacccacagcgcgtcatctacctgggcaccttctcgaaggtgttcgcaccgggcgtccgttccggctggatcgatccgcccgccaatcttgtcgagaaactccgcgctgtgtgcgagatcatgacactctcgccatcagccctcaaccaagcgatcatcggcgagtaccaccgtcgtcacggatgggacgaactgttggagggctatcgcgcctcctaccgcgaccgagcccgtctcctcatcggggctctcgaggctgaactggcaagaacgaattgcactggcacgtggacctggcgtgaaccacggggcggcttctacctgtggttggagaacgtcgccagcaccagcggtatcgacgttgcgcgtcgcgccgccgacaacggagtggccgtggtgcccgggaaacacttcgacgcagccggacacgattcgccgagcctgcgggtgtcgttcagcaattcacgcccggctgatctggtcgaaggagctcgtcgtctcgcccgtgcactggtgggagaggacgttcagaaatgactctcgcgacacgcaccgccaccgacaccctgcagcagaccttgccctggggcacccacgaacgtctcgtcttcgggcgggcgctcctgcgcagcaccggcttcccagccgaaggcttggccctgctcgactccgacgacatcctccccctcctcgactcctttcttgccggggacatcgacagaactcacttcgagaaggaatacaccagtcgcgaggagtccggcgcaagggcgctcatcaacgtcttgaaggacgatgcagtatcgcgcgccatcgcatggcagaaccccaccgcgtggaggtccttcgaatccctgtcgtccacgagcggaatcaatgcttcgactcggcgcaaggtacgccaactcgccctctactggcaacgttactgttccaaggctgagaccattggatacttcggcccgttcgcctgggccgaagtcgacccggaggcctctgcggtcgaattcatctcctccgaccatctgatcgaccgttcccacgtcgcaatggaggcgtgggcggtcattgagatcgggaaagccctggcatcacgggccgaccttcagtggtggatgccaccaatcctgtcccccgccgtcgacctcaacatggagagaggcaccgtgacggtggctggacaccagccacgacgggtccgggaggacgaggcacgagttctcttcctgaccgacggcacccgtcccgccgcccagatcgccaagagcctcgacatggagcccgagcggttgcgcaggatcctcgtggcccatgaacgtcgtcacaccgtgatctgggacgccaacatccctgtctcagtgcacgcgtgggacatcctgcacgaacgcattgcccagatcggagacgctgggctgcgagatgaggccactgctgttctcacgaggttcgacgagcttctggaggtcatccgcaacattcccgacgcccggtccctgacggaggcgacggaatccctgtcccgtcttttcgaaaccgtgacaggaacctcttcgaacagacgtgcgggccaggcatatgcagcccgcagcctgtgctacctggactgcacccgcgccggaaccgccaaggttgggacccggcttctcgaagccctcgacgcccccctcaacctcgtcctacaatccgctgactggttcgcggcgaccttggcaaaggaatacaccaccgaaatcacggacctcgcaaatcgaaagcagcgggcctcccaccagccactgaccatggctgatgtctggccgtccacgatgtcgctgttctggggggactcaccgtccccactgcagcgagccgtgaccgaactgtcacggcggtggagcagagtcctcgaggggctgcagccagtcgacggtcgcatcgacacgacatcgtccgctctctcgggcgccgtggacgagcagttccccgtgtgcaccccgattccagaactgtcagtgcacagcccggacctccaggtcatcacctcgagcactagcaacatcgcctccggacgagtcactgcagtcatgggtgagctacatgcctgtctgagcagtctcgacatgccgttgctcgagtggtcgctgccccatggttccattcgcgatcgcatcaacaccgcgctcaacctgcgacgtctggttcccttgttccccgagacatggaggcgcaacaccggccgcatggttccagcgacggtcggagtgggggatcgcgcaatcgggttcactcggacggccgatcaagaccgtgcgaacacatggtcgatgtcggcactgctgttcgagcagaccgaggacggactcatgatccgtgatcccgatggcaggctctggaccatcgcacaagcgtggagcgtgcccatctccatggtcgccgccgatgcgttcaagatcgggctgcccggctcaccagcccctcggctcaccattgacaatctcgtcgtgttccgtcgtacctggaggtttcccgctggctccatcgacatcatgcacggttcagccgccgagaaacacgctcggctgagggagtggcaggtcacgaatcaccttcctgaccacctcttcgtcaagttcccctccgaacccaagccgatctacttctccttcgagtcccccgccatggccacggtcttcacgcgatcactgcagcgcgacgcccgagagaatccagacagtctcgtgacgatgtccgaagcactgcccgagcctcaatcctcatggctgcacgacacccggagccaccactacgtccacgaattccggctgcaactgaccaaggagcgacatgacgaccacagttgagacacatcccgaaacacgtggcacaaccgcgacatccatctccaatctgatcggtcacacccctctcgtaagaatggaccatctgttcgacggcctccccttcgaggtgtacggcaagctcgagaagctcaatcctggcggaagcatcaaggatcgagcagcacaatccatgatcgaacgggcaattcgacggggtgagatcgtcccgggccgtacgaccgtcatcgagtccagttcgggaaatctcggcatcgccgtggcgatactgtgccaggagcacggcctgaatttcatctgcgtaaccgatgccaaggccacgccaacgaacattcgactcatcgaagcgttcggggccactgttgaggtgatcgaagaacctcatcccgagagtggcgaattcctccccatgaggctcaagagggtaagagaactgctgtcagagattccagatgcatggtggccgaatcagtacgggaaccccgacaatccggcggctcacgagcggactgtccgcgagatcatcgaggcaatcccgcgggttgacacgattgtctgcgcgaccggctcgtgcggaacccttcgcggctgccacgaagcattgcgaaagctgtccccacgcacccgactcgtcgccgtggacgccaagggcagcgccatcttcgacgaggcaggagcaccccatccccgctgtgtcccgggacacggtgcgtcagtgcgaccgccgctgtggcgcgcggggctcgccgaccaactggttctggtctccgacgcggactgcgtcgtgggatgccaggaggccctgcgcaccgaggctcttctcctcggcggatcctcgggagcaattctgacggccattcaccgagtgtctcccacgattcccgctggttccaccgtggtgacgatcctccccgacggcggcgagcgctacatcgacaccatctacagccgctcgtgggtcgactcacacatccccgggctgccctctctcgccgactggggggctcccaaccccgccaattcgtatgacctgaacagaagtgcctcatgaagctctacaccagagagaccgtcgaaactgcgcttgtcgggcgtcatggccaggttctcagtgccgtacagagtgcatacatgctgcattcgacgggagagacatcgctgccattctcaaccttcctccgcccggccgggtatccgaacgatcggatcatcgcacttcccgcccacatcggaggcgacttcgacatagccggtatcaagtggatctcatccttcccggaaaacctcgaccggggccagcaacgagcttcctccgtactcatcctcaatagtctggagacgggatacccgaccgccctgctggagtccagtcagatttcagcaacgcgaacggcagcatcagccgccctggccagcgccaccctccatggctccgaagaccatgtcagcacgattggcatcatcggctgcggaacaatcaatcttgcaacgatcgactacctcttccacgtgcacccccagatcaacgaggtcctctccttcgatctgaggcgggagcgggcccatgagttctcgcacctcgtcaaggcttcgcacccagaggcccgggtccgtgtcgccaaggagcccgacgagattctggccgcaagcaacaccatcgcgatcgccacgaccgactcgagtcattggttggaccttccgccgtggcacgggccggggcaccaagtcgtcctgcacacgtcgctgcgagacctgtcagtgccctcgatcctggcagcggccaacgtcgttgacgatcctgatcacgtctgccgtgaagcgacgtccttggatctggcaactcagcagaccggcaaccgggacttcatcacggggagaatcggagacctccttcttggcgcgccgctgtcctcaagtcctgactcccgtgtcattttctcacccttcgggctcggcatcctcgacctcgcagtcgcctccgtcgtcattgctgccgcctcctcttcagcagtcgagatcaatgggttcgaccccgggaaacacgccacaagcatgattgaggtgaatcgatgaccaccacacagatcaacgacaacacggccgttctgcgcgacgtattccccgccggctccgtcgcattcgtgagcggtgcctcacgcggaattggcgctgcctgcgcgacagcccttgcggccgcgggatgcaacctcgccatcacttatcgaaggaaggagaacgaggcggcacaaatcgccgaatccattgaagccatcgggcgccagtgcatcacaatgcagatggacgtaaccgatgagaaccaagtgaccagagccttccgcatcattcgccagcattacggacgcctggacgccgcggtcttgaactcgggaatcaccagtgacgggcatcttgcaacaatgagccgctccaagtggagctcggtgatcgacacgaatctgaccggaaccttcctctgcacgcgcgaggcgaccaaggccatgtactcgtccggtggctcgatcgtcatggtcgcgtccaccagtggagttgcagggcgaccgggccaggccaactacgcagccagcaagggcggaatcgttgccatgatgaagacgctggccccggaggttgcggcaaagaacgtccgggtgaatgcggtggcacccggcttcattcagaccgacatggtggcggccgttccaaaagcggcactcgcccaggcaatccaacacatccccatgggccgtcttggcctggcacaggaggttgcgtcagccgttaccttcctggcctccccgctcgccgcctacatcacagggaagaccctcactatcgatggcggaatgatcaacggctgaccccaggacccgcacacccccagtaccgagaaagaaacaacaatgaccgagatcacccacactgccaacagcatccgaacccgcgccgaggaacgttccaacaaagcttggcgcctgaaggaggagatcatctccaagctcggtctcgagaccaagccagaatatgtctcggacaaccaaccgctcttcggacgtggccttgagatggattcccttgacactctcgaagtcgtcgtcgccgtcaacaatgagttcggagtctcggtcaacgacgacgacgtacaggcgttcggctcgatcaatgccatggtcgatttcatcgaggtgaacgagaagtgagttctcttgcgctcgaggcgccacccaaggacgcccgtaagaaattcgcctacgacagcgatgccatcaagacgatgctcccacatcgttggccgatgctcatgattgatcgcgcctacgacgtcgtcccagggaaatcgggcaaaggcatcaagtcggtcagcgtcaatgagccgttcttcgccggtcactaccctgaccattccatcatgcccggcgtcatgatcgtcgagtcgatggctcaactcgtggccgtcatctacgtagccgaggccattcagaacaatcccggcatgacgtcgcacgacgcacgttcaagcgttggttatctcggcgcgatccgtcagatgaagttccgacgcctcgtcactccgggcgaccaactcaccctccacgcccagctcggcgagaaagtgggggctctgcgcgaggtttccgtgagagcactcaatggccgggatgtcgtcgcccagggggaactcgtcgtcaccgagcggtgacacccagccacacacgagaaggaagtcccatgatcgttcgcccctacaggccacgtgatgcggaagcgatcgtacatctctacaacagccattccgactcccccaatccagtgtcgggagggattgttgaggaggagttccagagggagctcgaagaacgtggttcgacagtgttcctagtggccgaggaggccggatccattgtcggcacattcgggatgttccgcacgaatggccgacacaccatggccgatgatgaagtcttcgccgacatgttctatgtcaccccgtcacatcgactctcgacagttccgggacagctaatcactgaagccatcagcgagtgcttcatccagggcatcaacgtgatccgcctcaccgtgaaccccgcgaacatctccgcgctcaaggtttacagaaaagtcggttgtgcctgtctcggggccaccgatgcaggcgaggacgggaacattgagctgtacaacttcatccctctggttcttagggcaaccatcaccaaactcgaccacgattgtattcgagccctggcggacatgacttcgttcgcctgcatcaccgagggacgtccacttgatctgtcccacgacttcatcgtggacgctggacggaagatcgtctcccacagcatccagatcgggcgttcaaccatccacgccatggtcgacacgggctcgaggaccattgtggaggccaccctcgacaaccgcgactgggatgctcctcgccagatcgtcgcccccaccccctgtcagaaccggcccgaggaacagcgaggcaaccctgtccggctggtgcacaagaagcttgaggtcaccttcaacgaaggagtcattgagatcagtacgactggccactggggcccggtcctcgcaatgtcctggccctcctccgtctcgcaccgcgctcacgggtggcgacagggccccgccaagtcgtatcgatgcgagcttctcgagaattgcctcgtcctggatgacgaaggaggagtgaaatgcaccatcagcctcaatgattgccaagtcgcgatccggatggatggtgccccaaaaacggaattgagaatgtaccagtggtgcagcctgcgccagggctatctgacggctgacaccggcatcacgagcttcaaccgggcatccagtgggctcggagtcgccgtccgggactcgtccgagattgtcgccgcgggccttcccgtcatccctgacacaccgatcacatggagtgagggtgacatcacggttcagctcgatccctgcggccgcgcctccctgatccactcgaccctggtggaccgaagaatccacttggacgagtctggctcggcaagtctcaccatgaccgtgtttggtgattcccagccccatcgtgccgacaccgtcgagctgcctcccctcgcggcaggcaccgacaggatcgtcctcaagccggctgccggaggcgtgaccacatggcgcttgggcgccaccaaggtgctcaagtcaccgtggccacacgcccgcgcgctcgggcccaatccgatctggcgagccggcctgtgggtcagtcacgagccggatcgccacgaccgtcgccaaggaatggggtggggtcccgatcatcgcagttggaccctgtcggaagacaccatgaccagtactgacgggacactctcctggcgcttcagcggctcccccgacaccggctggacggtcgacgtcacgacgagcaacacgcacggggagaccgtcgtctggctcaccccggactgcccggcgggcgagaggatccgcacgtctgatcatgccgtgacgaccatgcttgacatctcgaagccatggcagcgctggaccacccgatgcgcaattcctctcagacacgggaagtggttcctcatcgagcctgatcatgacctcactgattcccccgaaatcctcatgcgctctgttcacggggtcctgctcgtcggctgtgtcggacgagcccactccggatccgcttcctggcgctttgccatcacgtcagaactccccacctccaacccaagaagaaacgactacacctcagccgcctgaacccaaccagttggaacacccactacagaagaaatggagcaccaccatgtccatcactgagcagtacaagacccttcgcacctcggtcggcctccacacgcctaccggtcccctggtccgtatcaccggtgatgatcgtctcgagtttctcgacaccttcctgtcccgcgcctcggacttcgtggaccccgacaccactcgggagtgcctcgctctcaccgaggacggccttccgctgacgatcttcctccacatcgagcgcgaggaggagtcatggctccttccccgcaccgccatcgatgcggcgaccctcgccacgtacctcggcaacctcgagaccgatggtgacctgtcaatcgagattgctccagagggttggggagctgtcgctgtcgaggggccgctgtcgtggcagatcgccgaaaaccttctcgacttcgacgtggctggcctcgttcttcacgccgtcacggacgtcgtcgttcccggggcccccgagggatcgaaggcatggctcgcccgggtcggaaccactggagagtacggctacctgctcgtctccaacgttcccgacctcgcccgcacttatctcctcagccgcgccacggagctgggcggtcaggcagtcgacgccgatgctctcgcacgagtccaggccgaggccgggatgccctattacgcgatgggcgtgtgccacctcgatgtcgccgggggtgacctcgcctggctcgtggactggcagcgcatcggcgagttccaaggatccgagaatctgcccacacccgtccgagaccagcgccgactggccgccatcgccctgcccaccggcaaccgcccggaagctggtcagaccgtcgctgccggggatgaggagattggaatggtggtgtacgtcaccccgtccgccaatcccgatgaggaactcgcgttcgcacttctggatgctcctttctggactcccacccttccgttgaccgtcggtgcccacgacgggaccacggtcaccctgccccgcgtcgtggcagcctccagcctcaacaagctggggtgacagcgatgacgatcactgctgagaacgccaccacccgcagcgacattgcccggagcattgcggtgaccggcgtgggactggtcacggcacagggtgaccataccgacgagtgctggaccgaacttgtcgatggggtttgcggaatcaccatgaacgtcacgttcgatgactctggcaccacgattccgtgtgctggcgtggctcccattccgaactctgattcgatcgaccgctgttacctgctcggcgtccatgccatgcgtgaagctctcgagatgagtggcatcgacctggactccgtgggtcgtgatcgcatcggactcgtggtgggctcaagcctcggcgcgatgcccaccttggaggcggctcatcgccgggccattgagaccggcgtgctcgatgccggattggcggcagactcccagctccactgcgtcgccgaccacctcgccgctgagttcgacatccgtggaccccgcgtcgtgacatcgaatgcgtgtgccgctggtgccgtggcgatcggctacgccgcagaactcctctggtccgacgatgtggacctggtcgtctgtggcggtgtcgatccactggcccagatctctgccaatgggttcacgtgcctgggagctctcgacaatctcccatgcagcccgatggccggttcctccggtctgactctgggcgagggagccgggttcatggtcctcgagagaacagatgcggcggctgccagaggccaggaggtgatggccgaaatcgccggctacggcacaagttgtgatggttaccaccagactgccccggacccgggtggcaatggcgcccgcagctcaatggaggccgccctgcgctcagctcatctcaagccgtccgacgtcagctacgtcaatctccacggcaccggtactccgaccaacgacgccgtcgagccgaaggcactccggtcattgttcaagtccgatgaccttccccctgtcagttcggtgaagggcgccatcggtcacactctcggcgctgctggcgccatcgaggccgtgtgctcgatcaaggccatccacgagggggtcctgccgccaaccgtcaacaaccgcgggcaggcttcccgaactggtctcgacatcgtgccggagtgcgcacgcaaggccgctcccgacgtggtcatctccaactccttcgccttcgggggcaacaacgcatcagtggtcatcaccgcacctcgaggaggcgttcactgtaccgccccggcgcagcttcgcgaggtcggaatctcaggaatggcagctctggcgggaaaggccgccaactcggaggagcttctttcggccctgtcagaagattgtccaatctggatggccgatgagaagacctgggaaggggatgctgtccaaaccggccatgtggacatcaagcgcctgtcccgcacaatcaacccgtccaaggttcgtcggatggaccccttgggaatcatctccagcgcggtggtgactgatctgtatgcccgacacgggaagctgagccgcaaggatgccgaaagcacgggaatcatcttcgcaaccggctacggtcctgtgacggcggtgacgcagttcaatgacgggatcatccgccacggttccgagggtgccaacgccctggtgttcccgaacaccgtggtcaacgcagccgcaggccacctcgcgatgctgaatcgctaccgtggttacacggccaccttggcatgcggtggaaccagttcactcatggcgctgcttctcgctgctcgcgtcgttggccgcggcgctgcggatcgcatcatggtcgttatcgctgacgagtttcccagcattgccgtccaggccgtcgcgaagcttcctggctaccgacacagggttgatggttccggagccgtgctctcggaaggcgcggtatgcgtcctggtggaggccgtcgaagtcgccgaagcacgcggtaccgcccccatggcgctgctacgcggcttcggatcccgtggagagtccgtgggagtcggtcacaccgcatccgatggacgggcttgggccaaggccatggccgctgcactgggcccggccggcctgactgcctccgacgtgtcgaccgtcgtggcggcatcaagcggacatcctcgcgtcgaccgagccgagcaggcggccaggcggatcgtcggactgtccgcaaccgctacgaccttcccaaaggcgattgtcggagaaacacacggatcggctgccgggatcgggctgttcggtgccctgtgcggttcgaggtcagccgcgcaccagaacatccttgtcaacgccttttcccacggcggtggttatgcctcgatggtggtggagtcactgtgaccacgacgcttctgccacgggttgcccagccgggaccgggcgtcagccatgtcgacaccgaccgtcccatcgagtgcatcatcacccaccacccccacatgccgcgtgatcgcggaggccacgccacctccgtgtcaggcaggtacttgctgcgccaagccgcagaactcatgctcggcacggatcctgcgcattgccccgtcgtcgacccttcgcggcgctggtactggcccggaatcaatcttcacggttctgtctcccatgtcccgggctggagcctgacgacgctgagcaccggcggccacatcggggcagacatccaggacttccgggagcgtcccggcgcaatggcattcatcggtgacctggtcaagctgtcgcgatcggcgtcactccgagaattcgcggagtgcgaggccgtcgtcaaggtgtccgaattgactaaggagacgttcgggcacgtgcgactgcccgaatggacacccggatggcgccacgttttcgaggactactgggtctggagtctcgagatgcacgggatgggagtcatcgcactcgcatccgatctcccccgagccattcgctggtggcggtgcgacgccgatgcccgtggccgtctccaggctctccgacccataagcagtcttggaccaggaaggccgtcatgagccggtactcacgtcgaatctcaggcatcgaacgcggctatctcaacgccgcaacccggggcccgcaccccaccatccacacgatgatcgacttcgagggccgcgtccccgccgactgttggcggcacgcatccacgattgcgtcggccgccaaccctggcatgacagtggtccggaggtcgggccgatggacatccgatccagcgggctgtccggttgtgttccacgactggaccgcggaccccaacgacgttgccgacttccacgctgacatggatctcgtgacgggaccatcgtccacgctccacgttttcgagggggcggaacgcacccgaatcaccttggcagcaagccatgccgtgaccgatgggcggggcatcgaacgatttctcgtcgacctgcttgcagcgttggacgagcgtgaacccattggaagccccgacaccctgaccgatgtcgatatcaaacgatccttggagaacagcatcaagccccgacgccacctggccgctgtgcccgccgatgtcctttctccactgggggggaggaagaaccaacgtatatgggcctccaggacgtggcacagtgccccgggagccatgagcggaagaatcgctgccgctgtggccgagatgatcgaccacgccgcaatgatcatcatcccggttgacatccggcggcacgtcccagaggtccgatccacagcaaacctaagtgcccaactgccagtgatcatcaccccgaaccagcgctggcaaagcatccatgggcatctgctcacggaccttgctcgccatcgagaccttgcgatcatcagtgaggatttccgccacaacaatccgttcgcatcgaccttggaggaaagccaggccatcggcctcgatggtgtctatccctgtgccgcaatcatctccgaccacgggaagctcgacctttcaaggttccagaccttggaactcaccccggtctcgatgcgaagcctcccgatgctcgttccctactccgcaatgttcatcagcagttgcaccgtcggcgagaccaccactgtcaccatcgctcatcgcgctgatgacgatcccgattccataaacaccttcttccaccacatcgaatcccagatgtccatctgagccacgtcgtccctggagagcaaacatgaccacccaaaatgtcatcaccccgccgcgccccgtcacctcccatgccacggcgaccaggtccgaggctccaccgcgaagcgtcatcagagccatggccatctcgatggtcgcgaccctcatggtcatgctcgacacgaccgtcgtgaacgtgtccttgagcgcgaccaccgcccgcttcgggagcatgggcagcgtgcagtgggtcctcacaagttacctacttgcactgtgcgcgacgatgacggcctccgcctgggtcatcgaccgccttggtccacggctcaccttcatcgcctcaatgaccatgttcctcatcggctcggtgatgtgtgcactgagcgattcagtgtggcaactcgtcactggcaggaccatctccggtgccggagctgggatccttgttccgacagcatccgtcctgcttatccgtggcatcccacgcgaacaacttggcagggtgcaggcactgaatgggagtgtccagttgatcgctcccctgatcggcccgactgtgggcggtctcctcgttgacaggtgcgggggctggccggccatctactgggcgaacgtccccgtagctcttgttcttctgattgaggccgtccgcgtcgatccggacgaaccacacaccgctaagcgccgcctcgatgctctcggcctggtctgtggcagcaccgcgatcgtgctgacagtgcttggtgtctcactcttcggcaggacgtcgcgaaacaccaccttcctgcttacgatcggcgcgcttgcagtcctcgcatgggcgttcttcatcacccacatccgaagggctaccaaccctctgcttgacgtttccctgtatcagaaccctgtctattcatggtccagcttcaacgtagcggtgcttggtttcggtctctacgcccccatggtcgtcatgcccctctatctcgaggcgacgcgccacctcactgccgtccacactggtctggtgatgtcagtggccggcgtcggcgtcattatggccggaatcctgtgcacgaagatcatgggccggatcggtggaggcctcacgatgacagttggcataactctgagcatcatcgccactctgcccctggtccggctgacgaaccacacctcctacatactcctggcagtctgcttggccttgcgtggagcaggaatcagcctgacaatcgtcccagccatgacacgggccttcgagtccatcaagaggacggccatggcggacgcctctgcacagctcaacctgttgcagcgaatcggcgggacaattgcgacagcagtcatcatcgcagttatccaccacgaggccatgctcacccgcggactctcccccacagtgttctcgcacgccaacgtgtggatcctcaccgcgaccgccgtcacccttctgccggccttcgcgcttgcgaaggccgaaagacaacagcaggatctctgagcaccgaggagtactccctcgtagaccctcctctgatctaattgggttcgttccaagtgtgtatctcactccggggagccccgattgctgaaccacatcccgttcaccctggcgagtccctcgtggtacgacgtcccctgggcgcccggatctccgtatctcacaggagatatctcggtcctgccagcggactcgccaaggtggacgacgaccatccggggtccttggcaaatccacatgccacctcgtccgacccttccagaggtggggtggaaagtgcatgtgtctgccaagccatcggaattggaatcggttgcctcagtcgtagcactgtggtgcgtacgccacagcgtccccttcaaagtacttcgcacccgaggtctcgttcacgcgagtcaagtcaagtatgcggaccgaagtcagagcggcaaggtctgcacctgctaccccgacggcgagagccttgagcacttctgctccggtcttgccgagctgcttcagaacgtcgattcacctccggtgtccggcgagctgcgagtcggatcctcccctctgtggttgcgtcacgggagtttccgagaggcatgggcggtgtcatccacaggagtaccgttcccggtctacccgggaacaacacatcctgatcgtcgaggccccgcgcccgcagaatccgatcacgacacgccgtggatccggaggctccgtcggacgaatcgccccagcacggttcttcccatcgacgatgtcagactcctccaccgatcaaatgctggcggcgtgtatcaggcaacatggagagacggcacatcggtagtcgtcaaggaggcccggcacctgtccggacttgatgcggcgggtgtcgacgcccgagtgcggctgcgtcacgagtacgaggccctgagaagactggacccctatcgggccgctccccatcccattgatctcattgagaccgaggacggctcgttcctgatcatggaattccttgacggaatgacagtccaccaggagatgtcgaggttccatcctctgattagtaggcgacctcatcggctatcgatgaccgatttttcacgctggtgccgagaggtcgaagatcgcttgaggaatgtcacgagggtcatggccgggtgcggaatcgttcacggggatcttcatcccgcgaatctgatacatgtcggccatgaggttttggttactgactttgaatcctgctcaatcgacggggtcgccgtctcgtcagggatcgccgctccctggttccagtcggacgacacgattcccgatccggcgacgactgacgatctccacactcttctcgtggatccgacttgcggccccgcgcttgtcccccatccaaatcttcgcgcgctcatcagccaggccgcagtcgaggacatgatgggaaatccgactggtttaccacatgcctggaacctcgaggacatgacaagcgaactcgccaaggggatccgggcatcagccactcccgcacgagccgaccgcctctttccctcagacccctacctgttcgggcatccaggttcagaattcggcctgatgcatggcgccgccggaatcatggctgctcttgccgtgactgggtacggtgttgacgcgaatcacgtgacctggatgaaggaccgcttggccacccgcccgaccctgctgccggggttggccaacggaatcgagggaattgccctgggtctctccctgtgcggtcagaacgacatggctgcatccctgctccaccagtccggaattctcacgatcacaacgaacggatcgactgacctcaccctcggtactggtatggcgggccgagcgtgcgcgctgcagtccctctcacaacgactgtcatcgaaatctctcgcccacgctgcatataccctctgggaacaactcgccgtggctatgcggaacactgatgtggccttgccgaacggcctgttctccggttgggagggaatcgggctctccctgcttgcctctcccctgccggatcgtcatgatctcgcccgccactcactccgactggccctggccacgacaacgattgttgacggtgcgctcttctcaggcgagggacagatccgatggccatatctggggcgtggtcccgcggcatgtggcccgctcgccgccaggcttgatgatgaccagacggccaaggccgtggcacagacctgtcgttgtcccctgactgagtcatccggtctccacaatggccgcgcaggtctcctactcgtcctccgccagctcgtgggagaccaagacgacgccgttcgccgccacctcatgagactgtcgtggtcgatggaccgtcgcgaggaaggcacattgctgctgggtgatcatggcctgcgtttctcatccgatctcgcgacggggtcagccggcgccctcctcgccctgagcagggacccatggcggaacatgacacgaatgctcggaatatgcgatgacacctgtcatggcccactagtgacagtttgatctagcgccgatagttcacaactgaaagactccaaacatcgaggaaaacatgctgagccaaaacgccttggcaggcgtggctcgtttcaccacgatgaacaccaggagacagaatgtccgttgaggccatgcaatccatcgagatggacgaggaaaacagcgccagccagacagtttgcgcttgttacagcttcttctcgtggtcaggatgctgcgtagtctcccaagcggtggaagcatcttgatcgtgtgagacaccgtcgactaccctgtcccccgtggtacgcacacgccccgtcctggacagtcccggaagaccgctcatcgcctccggagtcgtcctggcggtcctgctcatcatcgcggtgatgacgatggtgcttcagcgcgaccccactctcacccccggacgccgcattctcggtatcgtcctgtccacggtccaggccgtcggattcatgtggctgcagacccgcatggttcgtcacggcaagggttcgcgcaacatgcgtgcgacccttggaagggtcggtttctgggccacgtggggactcgtcgcagtgggagtcgtcaatctgtggctgaccaactcgtggaccctcttcggggcctccgtcgccacgcccctccttctcctgccaggggtgtggagtgtggtggccaccctcgtgaccctgatcgtcggtttctccgacctcgtggtcacccacacctcgccactgacctcagccacggtcgtgctggtgaccatcgcggtgtcggtgaacctctacgcattcacgaagctgtcgacggcactcgttgaactccgctcctcccaggaggagatcgcccggctgcgcgtggacgccgagcgtcaccggatatcgcgggacctccacgacatcatcggtcgcaccctggtcgccacgtcgatgcgccagcaggcggccctccacctcgtcgaccgcgacccgcaacgggccaaggaacagctcgacgccgcccatgacgcaatcaccgaggggcagcaccagttgcgttccatcatccaggccgagatgagcaccagcctccccgacgagatcagcgacgccacattcctgtgcgaccgactccacatcgacttccgcatggatgaccgcggcagaccgcacaaacccttcgactcggcggcggcggcggccctgcgcgagggaatcacgaacatgctcaagcacagcgcggcgggctactgccacgtcgccatctccccggacctcctgaccgtcaccaacgacggttgtccgcaatcacctcgcccctccaccacaccgggcaccggaatcgaccatctccggtcccagatcgaggcgctcggtgggtcggtgacgacgtcgcggccctcgcggggcaccttccggctccgctgctccttcccgacccggggggcgtccacgaccacacccgcgaccgaaggaggacgatgacgacgagaatcctcctcgccgaggacatcaaactggtggcagaggccttcgaggcactgctctcggtggaaccggagttcgaggtcgtcgcacgggtggcacgcggcgacgacctggtcacatccgccacccgcctgttccccgacgtgatcctggccgacatcgacatgcccgggatgaccggcatcgaggccacccgaatgcttcgcgacaagggataccgcggcagaatcatcctgctcaccgccctgccgggaagcgggcacctgcacgccgcgatggctgccggagccgacgggtacctgctcaagtcgatcaccgcgccctccctcatcaacgccatccgggcggtgtgcaacggccagtcggccatcgacccgaacgtcgccgcggtcgccatgcgcaagggaccctcgcccctcaacgaccgggaaaccgagattctgcgcctagtcgccgacggttcctccaccgcgcagatcgcctcgcggctgtacctcagcaagggcaccgtcaggaactacctgtcgacggcgatgtcgaagctcgacgccgactcacgcacagcggcggtcacgcgggcacgcgaggagggctggctgtagcaggcgacccgctcagcccaccgcccctcagcccgccgactcctgacgcacggcctcctcgaccgcccggctgagcagggacccggccctgaccatcgacgtctccgggtccggctcgagatcggacaacgcgatgatccggtcgaacgcggaccgtttctcctcgggcaggtcacagcgtccgcacaccgcccagacgggcaccccggcgtcccgggcgatcttgcggatggtgtcgggaagcttgccgagcagggtctgctggtccagccgcccctcccccgtgacgacgagactggaggcggagatccgcgacaccgcgcgggaccatcccaggacgaccgccgcgcccgggcggtacctggtccccaggcacatcagcgcccagccgacccggctgggcggctgcgaaccccctggccaccgcccggcaggcctttcccgaactcagcgaccccttgaaggagtcgacggcaacgatgaccggcgcattcggatcaggacgcatgggatcagcatgtcacgtcgatacggagcagtcgcgccgcctacccctagactcgggggcatggtcaaccgagtctacctgtccctgagcgttctcgccctcgtgctgtgggtggtcgcctaccgtcacatgccgggctgggccgcgggcatcaccctggtgggcatcgtcgtgctgtcgctgtggtgcgagtggtcgcgggtgcgcaccctggccaggatcggcaagtcccgccagcagggcccccgctcctcccgaggacgcaacctgtcgtgagcaatacgattcccgcagccctccaccccggccctgacgaggcc

SEQ ID NO: 426 - DNA, 26620 bp, Propionibacterium acnes
ccttgtggacaccacgtcatccacatgacttgtgtcacatgattcccggaccatcatcaagcagatgctcacccaactgtaatgatttctgttctgaatctggacatgctctgacctgcattcaatgatcaattccgtgcgatattccacaacgcacggggaggtcgcagacaatgacaacagaaagcatccccacgcggctgctcgtgtggcacgagcagaccgatccgaccaagctcctcaggatcaccgacgcgatcaggaggggggatccccttccccccatcgaggccatggcgatcggccacagattcctcgtcctcgacggtgcgcaccgggcccaagcccaccagtactgccatcgatctgagatccgagcccgcctccacaacctccccctcagcgcggaaataccaggctggagccactccataccccgcgatgcagcagcgaaactggctcacctactcctccccgtggacgctctcggtcaggcggaaatcgtcctgcacggggtgcgccgtcaggtggggaccgcttcacaacgaccgcgcgacatctttctcgcctgccaccggatcgcgcgagttgcctacgcgcatggaatcagacctctcggcccggagttctccaacgctccgacgatcgacgccgccaccatgacctggcgcccgccgaacgtgggcacgttgtgggccatcgccagcagtctcggacccctgcccgcaactgtgacccggttcgccccgatcctccggcacgacgccatcggggattccgcgatgacacccgtcacctccgccgcgtgacgacccgcgccaattccgccccaccactggatgaggggcagccgcgtggacgatgctcctgttcaggcagggactccatacgagaccaataggaaaatcatgatcaaaaacacaagccctctgaccgtgaaaaatgtctcgaaaacattccgtggctccagcggagaagccatcaaggccgtgcaagacgtgtcattcaccgttgagcgtggtgaggttgtggcattcctcggcccgaacggcgccgggaagtccaccaccatcgacatggctctcggcctcacccgccccgacagcggccagatcgaggtcttcggtactgacccgctcagcgcggcccggtcgggacgctgcaccgcgatgacacagaccggcgggttgctgcccgacctcacgattgggcagaccatggagatcatctcctcgctctatcgtggctcccacatgaatgcctgcatggagcgagcaaggatcacgcatctggccgatcggcaggtgtcgatgtgctcgggaggcgagcgccaacgacttcgcttcgcactggctctgctgcccgatcctgacttcctcatcctcgacgagcccactgcggggatggatgtggaggcgcgccgggacttctgggcagagatccacgaggacacgcgtcgtggtcggacaattctgttcgcaacgcactacctcgacgaggtggacgagttcgccgatcgggtcatcctcatcaaggagggccgcgtcatcgccgacgacacctccgacgcgatccgcaccatgtcggggggttgcaccgttacggcgaccattcccgacttctccctggcacgactgaatctgccgggcacccaactcatcaagcagggcggcgcacgcgttgatctgcaccatcccgattccgatgccctcgcagcgcgagtcatccagctcggcggcaccgacctgcgcgtggtcccccgcagcctcgacgacgccttcctcgctctcacctcaaccaccaaggagtcctgacatgaccgcccaagcgcttcccgcagtcgccactcccaaggcccgccaccgatccgccatctcgctgaagtacttgtggtgcgagatgcgtcgccccttccggcgttcgacgatgctgttcaacctcgccctccccgcagttctgtacctggccctgttccgcaccgtccacaccgccgagctgccggacgggaacttcgcgatgtggatgatgatcggcatcgctgtctacggagcggccactgcgagcaccagctacgcagcctccatctccgtcgacgaggccaacgggtggacccgcaccatccgcctgacgccgttgtcgtcggtcgggtacgtgctggtgaaggtcctctgcgccatggccatcgccctggccccgaccctgctcatcggtctcatcgggctgttgaccggagctcacggcacgctgcgggtctgggtaatcggactgggggcggcttggctcagctcagcaatcttctccgccttcggcctggctctcggactgtccctgcgtcccgaggtcgtcatgcacgtccccggcctggtcatcaccggtctggcgttcctgggcaacgtcttcgtccccctcagcgggacgatgctcaccattggccgctggagccccgcctacggcatcaccgcgctggctcgttacccgctcaccaacggcatcgacatcgggggcggccacgactccctgacggctgccctcatcggcaccttctgctggttcgccggattcgtgttctgggcctcccgtcgatttaccaagagcacgggtcgtcagtgacagattcggccgatctccggaaggagcagtgttatgaccaagcccctcattgcagtggtcaccgcgggccaaggagcgcagaagcctcgcctgctcacgccatggctcaaggtccccggcgtcacggagaagcttgctgcatggtccgctcaggccgatgtggacctcgtcgagctcggtaccagggcgaatgcagaaaccttggcagcgaccgagaatgcgcagccactactggtctgtctcggagtcctcgtctcggatctcctggccgaccagaacattgtgctcgcaggacactccgtgggcgagctgacagcagcgtgtctcgccggggtagttgatcccgggacggccgtcactcttgcacgacggcgtggactggccatggcgcgggcctgcgctctccacccgaccaccatggcggccatcattggtgacaatccggatgacgtcctccggcggctctcggaactgggactcacggctgccaacatcaacggaggcggacagattgttgcggccggctccaccgacgcgatcgcggaactggtggcgacccctcccaacgggaccgcagtcaagccgttgcgagttgctggcgcctttcacaccaagtacatgacgcctgcgcaggacgctttcgcccaagctgctcaagacgtcaccttctccgacccgcagcacccgatcatctccaacctcgacgggcaggagatccggtccggcaatgacctgcgtgaacggctgattgcccaggtgaccgcgccagttcgatgggatctctgcatccagcagatcgcggatcgtcagccggaactcgccctatcggcccctccggggaaggtgcaggcgtcgctcttgtctcggcagatcccggacctcgcgacggtctgcatcaccacaccacgggaggcagcccaggctgcacagcggatcgaccagtccgtatccgtccttcagggggcatgatgctcatccccgagtacttcctcacagcctgttcggaccatgctgagcgcctggcgatcatcacccacaatgacgttgtgacgtgggccgaactggcgactcgcgtcgacggttttcggcgctggctgcgggaccatggcgtgcaccgccaggacagggtcgttctccagacgccaagcaccgtaggcacggtagccctcatgtgggcctgcctgctcgacggcgtgacgatggtcccggtgcaccaggacctcactgcctcccaggtgcagcaagtcatcgacgactgccgtccagctctggtgtgtggcagcccggacctcgtccaactcctcaactcccccggaatgaagacaagcacacctccaacgcggccggagtcaacgagtattctgccgtccttgtcccgggtcagccccgatgaccttgcgatgctcatctatacgtccggcacgacgggtctcccgaaggggatcatgtgtccccaccggcaggtcgccaccgccgcacggatcgtccatgactgtctcgggtaccgcacggacgacgtcattctctgtcgcctgccgttgtccttcgactacgggctctatcagattctgatgtctgccatctccggtagcgcggttgtcctgcgggacggaggcgcgcaggaccgcaacctggtgcgcgacatcgcccgtcacggcgtcactgtcgttccagtcgtgccgtccatggcgtcaatgctcatcaccctgcagcgtcgtgatcagttgccgaccatcgtcagactgttcacgaataccggggcgcgtctggcacccgagaccgcgaaccagttgctcgcaagcttccccggctcccgctatgcgtcgatgtatggcatgacggagtgcaagcgcatctccatccttccggtggaggagtacgagacgcatccggacagcgtgggaagagctctgcccagcactcacgtcgagatcgttgacgctcagggagttccggttccggcgggcgagcacggggagatcacggtgtccggcccgaccgtgatgaacggctactggcaggtgccgaacagtcccagtggacgattccgacccagcggccacggcctcactctgttcaccggtgatcgcggctggatggatgaggagggacgtctctacctcctcgggcgcgacgacgagatcgtcaagcatcacggcatccgaatcagcctgcaggagatcgagatagccgccgaagccgcgccgggcgtcgacgcagtcatcgctctcaagccggcctccgactcggcccccattgaaatcgcctactgcggcagcacgagtcccgagaacctggcccgccatctcgaaaccgtcctggaccgggcgcgacgaccccaattcatccaccaactccagcagatccccctgacccgtaacgggaaaccaaaccggtcagcagccgccgaggccatccgctcaagggcgtgacggcgaaggccaacacccacagacgaaaggaaaccaccatgacccaggccgagttcaaccagttcatcgagtccacctgctccgcgacgatcgtggatcccgaccgtcctttggtcgatcagggcatcgactccctcggaatgctcaccctcatggtcgctatcgaggacagcctcggcatcgaactggatcccgagtccctcgccgacggtaggggttccacgccctccggtcttctgtcccttgtcgagcagccgaaagcgacggtgtgacgacatgacgacgatggttccttgccgccgtgtggagatgccgcaactgttcgaccacatccccggaagcatctctctctcaggagggctgcccgatctgagcgtgctcccgagcaatcagatcgccgaactgacgtcccggatcatgcgtctcggctcaagaatcctcctgcaatactccaccccttcggtctcgtcctccttggtgccggccatcctggacctggcggaacgaacatgcatgtcaccggatccgcggaatctgatcccgaccgcgggttcccaactgggcctggccatggtgatcaatgcctttgacggcgatgagatcatctgtgactgcgccacctatcccggggcgctggccgccttcgcctctgccggcgtggaaacaacgggggtggccagtgacgaggaggggctcaacccagacgcgctcgctcacgccgtcgcagagggtcgggccaatggccgccgcatcgcagccgtctacaccacgcccaccttccagaatcccaccggctccgtacagtccgagaaccgccgtgcggccctgctcaaggtgtgtgctgacaatgacctcctcctcatcgaggacgatccgtacggcatgctgtccttcgacgggcagacgtggccagctctgaagtccatggacccacagcgcgtcatctacctgggcaccttctcgaaggtgttcgcaccgggcgtccgttccggctggatcgatccgcccgccaatcttgtcgagaaactccgcgctgtgtgcgagatcatgacactctcgccatcagccctcaaccaagcgatcatcggcgagtaccaccgtcgtcacggatgggacgaactgttggagggctatcgcgcctcctaccgcgaccgagcccgtctcctcatcggggctctcgaggctgaactggcaagaacgaattgcactggcacgtggacctggcgtgaaccacggggcggcttctacctgtggttggagaacgtcgccagcaccagcggtatcgacgttgcgcgtcgcgccgccgacaacggagtggccgtggtgcccgggaaacacttcgacgcagccggacacgattcgccgagcctgcgggtgtcgttcagcaattcacgcccggctgatctggtcgaaggagctcgtcgtctcgcccgtgcactggtgggagaggacgttcagaaatgactctcgcgacacgcaccgccaccgacaccctgcagcagaccttgccctggggcacccacgaacgtctcgtcttcgggcgggcgctcctgcgcagcaccggcttcccagccgaaggcttggccctgctcgactccgacgacatcctccccctcctcgactcctttcttgccggggacatcgacagaactcacttcgagaaggaatacaccagtcgcgaggagtccggcgcaagggcgctcatcaacgtcttgaaggacgatgcagtatcgcgcgccatcgcatggcagaaccccaccgcgtggaggtccttcgaatccctgtcgtccacgagcggaatcaatgcttcgactcggcgcaaggtacgccaactcgccctctactggcaacgttactgttccaaggctgagaccattggatacttcggcccgttcgcctgggccgaagtcgacccggaggcctctgcggtcgaattcatctcctccgaccatctgatcgaccgttcccacgtcgcaatggaggcgtgggcggtcattgagatcgggaaagccctggcatcacgggccgaccttcagtggtggatgccaccaatcctgtcccccgccgtcgacctcaacatggagagaggcaccgtgacggtggctggacaccagccacgacgggtccgggaggacgaggcacgagttctcttcctgaccgacggcacccgtcccgccgcccagatcgccaagagcctcgacatggagcccgagcggttgcgcaggatcctcgtggcccatgaacgtcgtcacaccgtgatctgggacgccaacatccctgtctcagtgcacgcgtgggacatcctgcacgaacgcattgcccagatcggagacgctgggctgcgagatgaggccactgctgttctcacgaggttcgacgagcttctggaggtcatccgcaacattcccgacgcccggtccctgacggaggcgacggaatccctgtcccgtcttttcgaaaccgtgacaggaacctcttcgaacagacgtgcgggccaggcatatgcagcccgcagcctgtgctacctggactgcacccgcgccggaaccgccaaggttgggacccggcttctcgaagccctcgacgcccccctcaacctcgtcctacaatccgctgactggttcgcggcgaccttggcaaaggaatacaccaccgaaatcacggacctcgcaaatcgaaagcagcgggcctcccaccagccactgaccatggctgatgtctggccgtccacgatgtcgctgttctggggggcctccccgtccccactgcagcgagccgtgaccgaactgtcacggcggtggagcagagtcctcgaggggctgcagccagtcgacggtcgcatcgacacgacatcgtccgctctctcgggcgccgtggacgagcagttccccgtgtgcaccccgattccagaactgtcagtgcacagcccggacctccaggtcatcacctcgagcactagcaacatcgcctccggacgagtcactgcagtcatgggtgagctacatgcctgtctgagcagtctcgacatgccgttgctcgagtggtcgctgccccatggttccattcgcgatcgcatcaacaccgcgctcaacctgcgacgtctggttcccttgttccccgagacatggaggcgcaacaccggccgcatggttccagcgacggtcggagtgggggatcgcgcaatcgggttcactcggacggccgatcaagaccgtgcgaacacatggtcgatgtcggcactgctgttcgagcagaccgaggacggactcatgatccgtgatcccgatggcaggctctggaccatcgcacaagcgtggagcgtgcccatctccatggtcgccgccgatgcgttcaagatcgggctgcccggctcaccagcccctcggctcaccattgacaatctcgtcgtgttccgtcgtacctggaggtttcccgctggctccatcgacatcatgcacggttcagccgccgagaaacacgctcggctgagggagtggcaggtcacgaatcaccttcctgaccacctcttcgtcaagttcccctccgaacccaagccgatctacttctccttcgagtcccccgccatggccacggtcttcacgcgatcactgcagcgcgacgcccgagagaatccagacagtctcgtgacgatgtccgaagcactgcccgagcctcaatcctcatggctgcacgacacccggagccaccactacgtccacgaattccggctgcaactgaccaaggagcgacatgacgaccacagttgagacacatcccgaaacacgtggcacaaccgcgacatccatctccaatctgatcggtcacacccctctcgtaagaatggaccatctgttcgacggcctccccttcgaggtgtacggcaagctcgagaagctcaatcctggcggaagcatcaaggatcgagcagcacaatccatgatcgaacgggcaattcgacggggtgagatcgtcccgggccgtacgaccgtcatcgagtccagttcgggaaatctcggcatcgccgtggcgatactgtgccaggagcacggcctgaatttcatctgcgtaaccgatgccaaggccacgccaacgaacattcgactcatcgaagcgttcggggccactgttgaggtgatcgaagaacctcatcccgagagtggcgaattcctccccatgaggctcaagagggtaagagaactgctgtcagagattccagatgcatggtggccgaatcagtacgggaaccccgacaatccggcggctcacgagcggactgtccgcgagattatcgaggcaatcccgcgggttgacacgattgtctgcgcgaccggctcgtgcggaacccttcgcggctgccacgaagcattgcgaaagctgtccccacgcacccgactcgtcgccgtggacgccaagggcagcgccatcttcgacgaggcaggagcaccccatccccgctgtgtcccgggacacggtgcgtcagtgcgaccgccgctgtggcgcgcggggctcgccgaccaactggttctggtctccgacgcggactgcgtcgtgggatgccaggaggccctgcgcaccgaggctcttctcctcggcggatcctcgggagcaattctgacggccattcaccgagtgtctcccacgattcccgctggttccaccgtggtgacgatcctccccgacggcggcgagcgctacatcgacaccatctacagccgctcgtgggtcgactcacacatccccgggctgccctctctcgccgactggggggctcccaaccccgccaattcgtatgacctgaacagaagtgcctcatgaagctctacaccagagagaccgtcgaaactgcgcttgtcgggcgtcatggccaggttctcagtgccgtacagagtgcatacatgctgcattcgacgggagagacatcgctgccattctcaaccttcctccgcccggccgggtatccgaacgatcggatcatcgcacttcccgcccacatcggaggcgacttcgacatagccggtatcaagtggatctcatccttcccggaaaacctcgaccggggccagcaacgagcttcctccgtactcatcctcaatagtctggagacgggatacccgaccgccctgctggagtccagtcagatttcagcaacgcgaacggcagcatcagccgccctggccagcgccaccctccatggctccgaagaccatgtcagcacgattggcatcatcggctgcggaacaatcaatcttgcaacgatcgactacctcttccacgtgcacccccagatcaacgaggtcctctccttcgatctgaggcgggagcgggcccatgagttctcgcacctcgtcaaggcttcgcacccagaggcccgggtccgtgtcgccaaggagcccgacgagattctggccgcaagcaacaccatcgcgatcgccacgaccgactcgagtcattggttggaccttccgccgtggcacgggccggggcaccaagtcgtcctgcacacgtcgctgcgagacctgtcagtgccctcgatcctggcagcggccaacgtcgttgacgatcctgatcacgtctgccgtgaagcgacgtccttggatctggcaactcagcagaccggcaaccgggacttcatcacggggagaatcggagacctccttcttggcgcgccgctgtcctcaagtcctgactcccgtgtcattttctcacccttcgggctcggcatcctcgacctcgcagtcgcctccgtcgtcattgctgccgcctcctcttcagcagtcgagatcaatgggttcgaccccgggaaacacgccacaagcatgattgaggtgaatcgatgaccaccacacagatcaacgacaacacggccgttctgcgcgacgtattccccgccggctccgtcgcattcgtgagcggtgcctcacgcggaattggcgctgcctgcgcgacagcccttgcggccgcgggatgcaacctcgccatcacttatcgaaggaaggagaacgaggcggcacaaatcgccgaatccattgaagccatcgggcgccagtgcatcacaatgcagatggacgtaaccgatgagaaccaagtgaccagagccttccgcatcattcgccagcattacggacgcctggacgccgcggtcttgaactcgggaatcaccagtgacgggcatcttgcaacaatgagccgctccaagtggagctcggtgatcgacacgaatctgaccggaaccttcctctgcacgcgcgaggcgaccaaggccatgtactcgtccggtggctcgatcgtcatggtcgcgtccaccagtggagttgcagggcgaccgggccaggccaactacgcagccagcaagggcggaatcgttgccatgatgaagacgctggccccggaggttgcggcaaagaacgtccgggtgaatgcggtggcacccggcttcattcagaccgacatggtggcggccgttccaaaagcggcactcgcccaggcaatccaacacatccccatgggccgtcttggcctggcacaggaggttgcgtcagccgttaccttcctggcctccccgctcgccgcctacatcacagggaagaccctcactatcgatggcggaatgatcaacggctgaccccaggacccgcacacccccagtaccgagaaagaaacaacaatgaccgagatcacccacactgccaacagcatccgaacccgcgccgaggaacgttccaacaaagcttggcgcctgaaggaggagatcatctccaagctcggtctcgagaccaagccagaatatgtctcggacaaccaaccgctcttcggacgtggccttgagatggattcccttgacactctcgaagtcgtcgtcgccgtcaacaatgagttcggagtctcggtcaacgacgacgacgtacaggcgttcggctcgatcaatgccatggtcgatttcatcgaggtgaacgagaagtgagttctcttgcgctcgaggcgccacccaaggacgcccgtaagaaattcgcctacgacagcgatgccatcaagacgatgctcccacatcgttggccgatgctcatgattgatcgcgcctacgacgtcgtcccagggaaatcgggcaaaggcatcaagtcggtcagcgtcaatgagccgttcttcgccggtcactaccctgaccattccatcatgcccggcgtcatgatcgtcgagtcgatggctcaactcgtggccgtcatctacgtagccgaggccattcagaacaatcccggcatgacgtcgcacgacgcacgttcaagcgttggttatctcggcgcgatccgtcagatgaagttccgacgcctcgtcactccgggcgaccaactcaccctccacgcccagctcggcgagaaagtgggggctctgcgcgaggtttccgtgagagcactcaatggccgggatgtcgtcgcccagggggaactcgtcgtcaccgagcggtgacacccagccacacacgagaaggaagtcccatgatcgttcgcccctacaggccacgtgatgcggaagcgatcgtacatctctacaacagccattccgactcccccaatccagtgtcgggagggattgttgaggaggagttccagagggagctcgaagaacgtggttcgacagtgttcctagtggccgaggaggccggatccattgtcggcacattcgggatgttccgcacgaatggccgacacaccatggccgatgatgaagtcttcgccgacatgttctatgtcaccccgtcacatcgactctcgacagttccgggacagctaatcactgaagccatcagcgagtgcttcatccagggcatcaacgtgatccgcctcaccgtgaaccccgcgaacatctccgcgctcaaggtttacagaaaagtcggttgtgcctgtctcggggccaccgatgcaggcgaggacgggaacattgagctgtacaacttcatccctctggttcttagggcaaccatcaccaaactcgaccacgattgtattcgagccctggcggacatgacttcgttcgcctgcatcaccgagggacgtccacttgatctgtcccacgacttcatcgtggacgctggacggaagatcgtctcccacagcatccagatcgggcgttcaaccatccacgccatggtcgacacgggctcgaggaccattgtggaggccaccctcgacaaccgcgactgggatgctcctcgccagatcgtcgcccccaccccctgtcagaaccggcccgaggaacagcgaggcaaccctgtccggctggtgcacaagaagcttgaggtcaccttcaacgaaggagtcattgagatcagtacgactggccactggggcccggtcctcgcaatgtcctggccctcctccgtctcgcaccgcgctcacgggtggcgacagggccccgccaagtcgtatcgatgcgagcttctcgagaattgcctcgtcctggatgacgaaggaggagtgaaatgcaccatcagcctcaatgattgccaagtcgcgatccggatggatggtgccccaaaaacggaattgagaatgtaccagtggtgcagcctgcgccagggctatctgacggctgacaccggcatcacgagcttcaaccgggcatccagtgggctcggagtcgccgtccgggactcgtccgagattgtcgccgcgggccttcccgtcatccctgacacaccgatcacatggagtgagggtgacatcacggttcagctcgatccctgcggccgcgcctccctgatccactcgaccctggtggaccgaagaatccacttggacgagtctggctcggcaagtctcaccatgaccgtgtttggtgattcccagccccatcgtgccgacaccgtcgagctgcctcccctcgcggcaggcaccgacaggatcgtcctcaagccggctgccggaggcgtgaccacatggcgcttgggcgccaccaaggtgctcaagtcaccgtggccacacgcccgcgcgctcgggcccaatccgatctggcgagccggcctgtgggtcagtcacgagccggatcgccacgaccgtcgccaaggaatggggtggggtcccgatcatcgcagttggaccctgtcggaagacaccatgaccagtactgacgggacactctcctggcgcttcagcggctcccccgacaccggctggacggtcgacgtcacgacgagcaacacgcacggggagaccgtcgtctggctcaccccggactgcccggcgggcgagaggatccgcacgtctgatcatgccgtgacgaccatgcttgacatctcgaagccatggcagcgctggaccacccgatgcgcaattcctctcagacacgggaagtggttcctcatcgagcctgatcatgacctcactgattcccccgaaatcctcatgcgctctgttcacggggtcctgctcgtcggctgtgtcggacgagcccactccggatccgcttcctggcgctttgccatcacgtcagaactccccacctccaacccaagaagaaacgactacacctcagccgcctgaacccaaccagttggaacacccactacagaagaaatggagcaccaccatgtccatcactgagcagtacaagacccttcgcacctcggtcggcctccacacgcctaccggtcccctggtccgtatcaccggtgatgatcgtctcgagtttctcgacaccttcctgtcccgcgcctcggacttcgtggaccccgacaccactcgggagtgcctcgctctcaccgaggacggccttccgctgacgatcttcctccacatcgagcgcgaggaggagtcatggctccttccccgcaccgccatcgatgcggcgaccctcgccacgtacctcggcaacctcgagaccgatggtgacctgtcaatcgagattgctccagagggttggggagctgtcgctgtcgaggggccgctgtcgtggcagatcgccgaaaaccttctcgacttcgacgtggctggcctcgttcttcacgccgtcacggacgtcgtcgttcccggggcccccgagggatcgaaggcatggctcgcccgggtcggaaccactggagagtacggctacctgctcgtctccaacgttcccgacctcgcccgcacttatctcctcagccgcgccacggagctgggcggtcaggcagtcgacgccgatgctctcgcacgagtccaggccgaggccgggatgccctattacgcgatgggcgtgtgccacctcgatgtcgccgggggtgacctcgcctggctcgtggactggcagcgcatcggcgagttccaaggatccgagaatctgcccacacccgtccgagaccagcgccgactggccgccatcgccctgcccaccggcaaccgcccggaagctggtcagaccgtcgctgccggggatgaggagattggaatggtggtgtacgtcaccccgtccgccaatcccgatgaggaactcgcgttcgcacttctggatgctcctttctggactcccacccttccgttgaccgtcggtgcccacgacgggaccacggtcaccctgccccgcgtcgtggcagcctccagcctcaacaagctggggtgacagcgatgacgatcactgctgagaacgccaccacccgcagcgacattgcccggagcattgcggtgaccggcgtgggactggtcacggcacagggtgaccataccgacgagtgctggaccgaacttgtcgatggggtttgcggaatcaccatgaacgtcacgttcgatgactctggcaccacgattccgtgtgctggcgtggctcccattccgaactctgattcgatcgaccgctgttacctgctcggcgtccatgccatgcgtgaagctctcgagatgagtggcatcgacctggactccgtgggtcgtgatcgcatcggactcgtggtgggctcaagcctcggcgcgatgcccaccttggaggcggctcatcgccgggccattgagaccggcgtgctcgatgccggattggcggcagactcccagctccactgcgtcgccgaccacctcgccgctgagttcgacatccgtggaccccgcgtcgtgacatcgaatgcgtgtgccgctggtgccgtggcgatcggctacgccgcagaactcctctggtccgacgatgtggacctggtcgtctgtggcggtgtcgatccactggcccagatctctgccaatgggttcacgtgcctgggagctctcgacaatctcccatgcagcccgatggccggttcctccggtctgactctgggcgagggagccgggttcatggtcctcgagagaacagatgcggcggctgccagaggccaggaggtgatggccgaaatcgccggctacggcacaagttgtgatggttaccaccagactgccccggacccgggtggcaatggcgcccgcagctcaatggaggccgccctgcgctcagctcatctcaagccgtccgacgtcagctacgtcaatctccacggcaccggtactccgaccaacgacgccgtcgagccgaaggcactccggtcattgttcaagtccgatgaccttccccctgtcagttcggtgaagggcgccatcggtcacactctcggcgctgctggcgccatcgaggccgtgtgctcgatcaaggccatccacgagggggtcctgccgccaaccgtcaacaaccgcgggcaggcttcccgaactggtctcgacatcgtgccggagtgcgcacgcaaggccgctcccgacgtggtcatctccaactccttcgccttcgggggcaacaacgcatcagtggtcatcaccgcacctcgaggaggcgttcactgtaccgccccggcgcagcttcgcgaggtcggaatctcaggaatggcagctctggcgggaaaggccgccaactcggaggagcttctttcggccctgtcagaagattgtccaatctggatggccgatgagaagacctgggaaggggatgctgtccaaaccggccatgtggacatcaagcgcctgtcccgcacaatcaacccgtccaaggttcgtcggatggaccccttgggaatcatctccagcgcggtggtgactgatctgtatgcccgacacgggaagctgagccgcaaggatgccgaaagcacgggaatcatcttcgcaaccggctacggtcctgtgacggcggtgacgcagttcaatgacgggatcatccgccacggttccgagggtgccaacgccctggtgttcccgaacaccgtggtcaacgcagccgcaggccacctcgcgatgctgaatcgctaccgtggttacacggccaccttggcatgcggtggaaccagttcactcatggcgctgcttctcgctgctcgcgtcgttggccgcggcgctgcggatcgcatcatggtcgttatcgctgacgagtttcccagcattgccgtccaggccgtcgcgaagcttcctggctaccgacacagggttgatggttccggagccgtgctctcggaaggcgcggtatgcgtcctggtggaggccgtcgaagtcgccgaagcacgcggtaccgcccccatggcgctgctacgcggcttcggatcccgtggagagtccgtgggagtcggtcacaccgcatccgatggacgggcttgggccaaggccatggccgctgcactgggcccggccggcctgactgcctccgacgtgtcgaccgtcgtggcggcatcaagcggacatcctcgcgtcgaccgagccgagcaggcggccaggcggatcgtcggactgtccgcaaccgctacgaccttcccaaaggcgattgtcggagaaacacacggatcggctgccgggatcgggctgttcggtgccctgtgcggttcgaggtcagccgcgcaccagaacatccttgtcaacgccttttcccacggcggtggttatgcctcgatggtggtggagtcactgtgaccacgacgcttctgccacgggttgcccagccgggaccgggcgtcagccatgtcgacaccgaccgtcccatcgagtgcatcatcacccaccacccccacatgccgcgtgatcgcggaggccacgccacctccgtgtcaggcaggtacttgctgcgccaagccgcagaactcatgctcggcacggatcctgcgcattgccccgtcgtcgacccttcgcggcgctggtactggcccggaatcaatcttcacggttctgtctcccatgtcccgggctggagcctgacgacgctgagcaccggcggccacatcggggcagacatccaggacttccgggagcgtcccggcgcaatggcattcatcggtgacctggtcaagctgtcgcgatcggcgtcactccgagaattcgcggagtgcgaggccgtcgtcaaggtgtccgaattgactaaggagacgttcgggcacgtgcgactgcccgaatggacacccggatggcgccacgttttcgaggactactgggtctggagtctcgagatgcacgggatgggagtcatcgcactcgcatccgatctcccccgagccattcgctggtggcggtgcgacgccgatgcccgtggccgtctccaggctctccgacccataagcagtcttggaccaggaaggccgtcatgagccggtactcacgtcgaatctcaggcatcgaacgcggctatctcaacgccgcaacccggggcccgcaccccaccatccacacgatgatcgacttcgagggccgcgtccccgccgactgttggcggcacgcatccacgattgcgtcggccgccaaccctggcatgacagtggtccggaggtcgggccgatggacatccgatccagcgggctgtccggttgtgttccacgactggaccgcggaccccaacgacgttgccgacttccacgctgacatggatctcgtgacgggaccatcgtccacgctccacgttttcgagggggcggaacgcacccgaatcaccttggcagcaagccatgccgtgaccgatgggcggggcatcgaacgatttctcgtcgacctgcttgcagcgttggacgagcgtgaacccattggaagccccgacaccctgaccgatgtcgatatcaaacgatccttggagaacagcatcaagccccgacgccacctggccgctgtgcccgccgatgtcctttctccactgggggggaggaagaaccaacgtatatgggcctccaggacgtggcacagtgccccgggagccatgagcggaagaatcgctgccgctgtggccgagatgatcgaccacgccgcaatgatcatcatcccggttgacatccggcggcacgtcccagaggtccgatccacagcaaacctaagtgcccaactgccagtgatcatcaccccgaaccagcgctggcaaagcatccatgggcatctgctcacggaccttgctcgccatcgagaccttgcgatcatcagtgaggatttccgccacaacaatccgttcgcatcgaccttggaggaaagccaggccatcggcctcgatggtgtctatccctgtgccgcaatcatctccgaccacgggaagctcgacctttcaaggttccagaccttggaactcaccccggtctcgatgcgaagcctcccgatgctcgttccctactccgcaatgttcatcagcagttgcaccgtcggcgagaccaccactgtcaccatcgctcatcgcgctgatgacgatcccgattccataaacaccttcttccaccacatcgaatcccagatgtccatctgagccacgtcgtccctggagagcaaacatgaccacccaaaatgtcatcaccccgccgcgccccgtcacctcccatgccacggcgaccaggtccgaggctccaccgcgaagcgtcatcagagccatggccatctcgatggtcgcgaccctcatggtcatgctcgacacgaccgtcgtgaacgtgtccttgagcgcgaccaccgcccgcttcgggagcatgggcagcgtgcagtgggtcctcacaagttacctacttgcactgtgcgcgacgatgacggcctccgcctgggtcatcgaccgccttggtccacggctcaccttcatcgcctcaatgaccatgttcctcatcggctcggtgatgtgtgcactgagcgattcagtgtggcaactcgtcactggcaggaccatctccggtgccggagctgggatccttgttccgacagcatccgtcctgcttatccgtggcatcccacgcgaacaacttggcagggtgcaggcactgaatgggagtgtccagttgatcgctcccctgatcggcccgactgtgggcggtctcctcgttgacaggtgcgggggctggccggccatctactgggcgaacgtccccgtagctcttgttcttctgattgaggccgtccgcgtcgatccggacgaaccacacaccgctaagcgccgcctcgatgctctcggcctggtctgtggcagcaccgcgatcgtgctgacagtgcttggtgtctcactcttcggcaggacgtcgcgaaacaccaccttcctgcttacgatcggcgcgcttgcagtcctcgcatgggcgttcttcatcacccacatccgaagggctaccaaccctctgcttgacgtttccctgtatcagaaccctgtctattcatggtccagcttcaacgtagcggtgcttggtttcggtctctacgcccccatggtcgtcatgcccctctatctcgaggcgacgcgccacctcactgccgtccacactggtctggtgatgtcagtggccggcgtcggcgtcattatggccggaatcctgtgcacgaagatcatgggccggatcggtggaggcctcacgatgacagttggcataactctgagcatcatcgccactctgcccctggtccggctgacgaaccacacctcctacatactcctggcagtctgcttggccttgcgtggagcaggaatcagcctgacaatcgtcccagccatgacacgggccttcgagtccatcaagaggacggccatggcggacgcctctgcacagctcaacctgttgcagcgaatcggcgggacaattgcgacagcagtcatcatcgcagttatccaccacgaggccatgctcacccgcggactctcccccacagtgttctcgcacgccaacgtgtggatcctcaccgcgaccgccgtcacccttctgccggccttcgcgcttgcgaaggccgaaagacaacagcaggatctctgagcaccgaggagtactccctcgtagaccctcctctgatctaattgggttcgttccaagtgtgtatctcactccggggagccccgattgctgaaccacatcccgttcaccctggcgagtccctcgtggtacgacgtcccctgggcgcccggatctccgtatctcacaggagatatctcggtcctgccagcggactcgccaaggtggacgacgaccatccggggtccttggcaaatccacatgccacctcgtccgacccttccagaggtggggtggaaagtgcatgtgtctgccaagccatcggaattggaatcggttgcctcagtcgtagcactgtggtgcgtacgccacagcgtccccttcaaagtacttcgcacccgaggtctcgttcacgcgagtcaagtcaagtatgcggaccgaagtcagagcggcaaggtctgcacctgctaccccgacggcgagagccttgagcacttctgctccggtcttgccgagctgcttcagaacgtcgattcacctccggtgtccggcgagctgcgagtcggatcctcccctctgtggttgcgtcacgggagtttccgagaggcatgggcggtgtcatccacaggagtaccgttcccggtctacccgggaacaacacatcctgatcgtcgaggccccgcgcccgcagaatccgatcacgacacgccgtggatccggaggctccgtcggacgaatcgccccagcacggttcttcccatcgacgatgtcagactcctccaccgatcaaatgctggcggcgtgtatcaggcaacatggagagacggcacatcggtagtcgtcaaggaggcccggcacctgtccggacttgatgcggcgggtgtcgacgcccgagtgcggctgcgtcacgagtacgaggccctgagaagactggacccctatcgggccgctccccatcccattgatctcattgagaccgaggacggctcgttcctgatcatggaattccttgacggaatgacagtccaccaggagatgtcgaggttccatcctctgattagtaggcgacctcatcggctatcgatgaccgatttttcacgctggtgccgagaggtcgaagatcgcttgaggaatgtcacgagggtcatggccgggtgcggaatcgttcacggggatcttcatcccgcgaatctgatacatgtcggccatgaggttttggttactgactttgaatcctgctcaatcgacggggtcgccgtctcgtcaggaatcgccgctccctggttccagtcggacgacacgattcccgatccggcgacgactgacgatctccacactcttctcgtggatccgacttgcggccccgcgcttgtcccccatccaaatcttcgcgcgctcatcagccaggccgcagtcgaggacatgatgggaaatccgactggtttaccacatgcctggaacctcgaggacatgacaagcgaactcgccaaggggatccgggcatcagccactcccgcacgagccgaccgcctctttccctcagacccctacctgttcgggcatccaggttcagaattcggcctgatgcatggcgccgccggaatcatggctgctcttgccgtgactgggtacggtgttgacgcgaatcacgtgacctggatgaaggaccgcttggccacccgcccgaccctgctgccggggttggccaacggaatcgagggaattgccctgggtctctccctgtgcggtcagaacgacatggctgcatccctgctccaccagtccggaattctcacgatcacaacgaacggatcgactgacctcaccctcggtactggtatggcgggccgagcgtgcgcgctgcagtccctctcacaacgactgtcatcgaaatctctcgcccacgctgcatataccctctgggaacaactcgccgtggctgtgcggaacactgatgtggccttgccgaacggcctgttctccggttgggagggaatcgggctctccctgcttgcctctcccctgccggatcgtcatgatctcgcccgccactcactccgactggccctggccacgacaacgattgttgacggtgcgctcttctcaggcgagggacagatccgatggccatatctggggcgtggtcccgcggcatgtggcccgctcgccgccaggcttgatgatgaccagacggccaaggccgtggcacagacctgtcgttgtcccctgactgagtcatccggtctccacaatggccgcgcaggtctcctactcgtcctccgccagctcgtgggagaccaagacgacgccgttcgccgccacctcatgagactgtcgtggtcgatggaccgtcgcgaggaaggcacattgctgctgggtgatcatggcctgcgtttctcatccgatctcgcgacggggtcagccggcgccctcctcgccctgagcagggacccatggcggaacatgacacgaatgctcggaatatgcgatgacacctgtcatggcccactagtgacagtttgatctagcgccgatagttcacaactgaaagactccaaacatcgaggaaaacatgctgagccaaaacgccttggcaggcgtggctcgtttcaccacgatgaacaccaggagacagaatgtccgttgaggccatgcaatccatcgagatggacgaggaaaacagcgccagccagacagtttgcgcttgttacagcttcttctcgtggtcaggatgctgcgtagtctcccaagcggtggaagcatcttgatcgtgtgagacgccgtcgactaccctgtcccccgtggtacgcacacgccccgtcctggacagtcccggaagaccgctcatcgcctccggagtcgtcctggcggtcctgctcatcatcgcggtgatgacgatggtgcttcagcgcgaccccactctcacccccggacgccgcattctcggtatcgtcctgtccacggtccaggccgtcggattcatgtggctgcagacccgcatggttcgtcacggcaagggttcgcgcaacatgcgtgcgacccttggaagggtcggtttctgggccacgtggggactcgtcgcagtgggagtcgtcaatctgtggctgaccaactcgtggaccctcttcggggcctccgtcgccacgcccctccttctcctgccaggggtgtggagtgtggtggccaccctcgtgaccctgatcgtcggtttctccgacctcgtggtcacccacacctcgccactgacctcagccacggtcgtgctggtgaccatcgcggtgtcggtgaacctctacgcattcacgaagctgtcgacggcactcgttgaactccgctcctcccaggaggagatcgcccggctgcgcgtggacgccgagcgtcaccggatatcgcgggacctccacgacatcatcggtcgcaccctggtcgccacgtcgatgcgccagcaggcggccctccacctcgtcgaccgcgacccgcaacgggccaaggaacagctcgacgccgcccatgacgcaatcaccgaggggcagcaccagttgcgttccatcatccaggccgagatgagcaccagcctccccgacgagatcagcgacgccacattcctgtgcgaccgactccacatcgacttccgcatggatgaccgcggcagaccgcacaaacccttcgactcggcggcggcggcggccctgcgcgagggaatcacgaacatgctcaagcacagcgcggcgggctactgccacgtcgccatctccccggacctcctgaccgtcaccaacgacggttgtccgcaatcacctcgcccctccaccacaccgggcaccggaatcgaccatctccggtcccagatcgaggcgctcggtgggtcggtgacgacgtcgcggccctcgcggggcaccttccggctccgctgctccttcccgacccggggggcgtccacgaccacacccgcgaccgaaggaggacgatgacgacgagaatcctcctcgccgaggacatcaaactggtggcagaggccttcgaggcactgctctcggtggaaccggagttcgaggtcgtcgcacgggtggcacgcggcgacgacctggtcacatccgccacccgcctgttccccgacgtgatcctggccgacatcgacatgcccgggatgaccggcatcgaggccacccgaatgcttcgcgacaagggataccgcggcagaatcatcctgctcaccgccctgccgggaagcgggcacctgcacgccgcgatggctgccggagccgacgggtacctgctcaagtcgatcaccgcgccctccctcatcaacgccatccgggcggtgtgcaacggccagtcggccatcgacccgaacgtcgccgcggtcgccatgcgcaagggaccctcgcccctcaacgaccgggaaaccgagattctgcgcctagtcgccgacggttcctccaccgcgcagatcgcctcgcggctgtacctcagcaagggcaccgtcaggaactacctgtcgacggcgatgtcgaagctcgacgccgactcacgcacagcggcggtcacgcgggcacgcgaggagggctggctgtagcaggcgacccgctcagcccaccgcccctcagcccgccgactcctgacgcacggcctcctcgaccgcccggctgagcagggacccggccctgaccatcgacgtctccgggtccggctcgagatcggacaacgcgatgatccggtcgaacgcggaccgtttctcctcgggcaggtcacagcgtccgcacaccgcccagacgggcaccccggcgtcccgggcgatcttgcggatggtgtcgggaagcttgccgagcagggtctgctggtccagccgcccctcccccgtgacgacgagactggaggcggagatccgcgacaccgcgcgggaccatcccaggacgaccgccgcgcccgggcggtacctggtccccaggcacatcagcgcccagccgacccggctgggcggctgcgaaccccctggccaccgcccggcaggcctttcccgaactcagcgaccccttgaaggagtcgacggcaacgatgaccggcgcattcggatcaggacgcatgggatcagcatgtcacgtcgatacggagcagtcgcgccgcctacccctagactcgggggcatggtcaaccgagtctacctgtccctgagcgttctcgccctcgtgctgtgggtggtcgcctaccgtcacatgccgggctgggccgcgggcatcaccctggtgggcatcgtcgtgctgtcgctgtggtgcgagtggtcgcgggtgcgcaccctggccaggatcggcaagtcccgccagcagggcccccgctcctcccgaggacgcaacctgtcgtgagcaatacgattcccgcagccctccaccccggccctgacgaggcc

SEQ ID NO: 427 - DNA, 26620 bp, Propionibacterium acnes
ccttgtggacaccacgtcatccacatgacttgtgtcacatgattcccggaccatcatcaagcagatgctcacccaactgtaatgatttctgttctgaatctggacatgctctgacctgcattcaatgatcaattccgtgcgatattccacaacgcacggggaggtcgcagacaatgacaacagaaagcatccccacgcggctgctcgtgtggcacgagcagaccgatccgaccaagctcctcaggatcaccgacgcgatcaggaggggggatccccttccccccatcgaggccatggcgatcggccacagattcctcgtcctcgacggtgcgcaccgggcccaagcccaccagtactgccatcgatctgagatccgagcccgcctccacaacctccccctcagcgcggaaataccaggctggagccactccataccccgcgatgcagcagcgaaactggctcacctactcctccccgtggacgctctcggtcaggcggaaatcgtcctgcacggggtgcgccgtcaggtggggaccgcttcacaacgaccgcgcgacatctttctcgcctgccaccggatcgcgcgagttgcctacgcgcatggaatcagacctctcggcccggagttctccaacgctccgacgatcgacgccgccaccatgacctggcgcccgccgaacgtgggcacgttgtgggccatcgccagcagtctcggacccctgcccgcaactgtgacccggttcgccccgatcctccggcacgacgccatcggggattccgcgatgacacccgtcacctccgccgcgtgacgacccgcgccaattccgccccaccactggatgaggggcagccgcgtggacgatgctcctgttcaggcagggactccatacgagaccaataggaaaatcatgatcaaaaacacaagccctctgaccgtgaaaaatgtctcgaaaacattccgtggctccagcggagaagccatcaaggccgtgcaagacgtgtcattcaccgttgagcgtggtgaggttgtggcattcctcggcccgaacggcgccgggaagtccaccaccatcgacatggctctcggcctcacccgccccgacagcggccagatcgaggtcttcggtactgacccgctcagcgcggcccggtcgggacgctgcaccgcgatgacacagaccggcgggttgctgcccgacctcacgattgggcagaccatggagatcatctcctcgctctatcgtggctcccacatgaatgcctgcatggagcgagcaaggatcacgcatctggccgatcggcaggtgtcgatgtgctcgggaggcgagcgccaacgacttcgcttcgcactggctctgctgcccgatcctgacttcctcatcctcgacgagcccactgcggggatggatgtggaggcgcgccgggacttctgggcagagatccacgaggacacgcgtcgtggtcggacaattctgttcgcaacgcactacctcgacgaggtggacgagttcgccgatcgggtcatcctcatcaaggagggccgcgtcatcgccgacgacacctccgacgcgatccgcaccatgtcggggggttgcaccgttacggcgaccattcccgacttctccctggcacgactgaatctgccgggcacccaactcatcaagcagggcggcgcacgcgttgatctgcaccatcccgattccgatgccctcgcagcgcgagtcatccagctcggcggcaccgacctgcgcgtggtcccccgcagcctcgacgacgccttcctcgctctcacctcaaccaccaaggagtcctgacatgaccgcccaagcgcttcccgcagtcgccactcccaaggcccgccaccgatccgccatctcgctgaagtacttgtggtgcgagatgcgtcgccccttccggcgttcgacgatgctgttcaacctcgccctccccgcagttctgtacctggccctgttccgcaccgtccacaccgccgagctgccggacgggaacttcgcgatgtggatgatgatcggcatcgctgtctacggagcggccactgcgagcaccagctacgcagcctccatctccgtcgacgaggccaacgggtggacccgcaccatccgcctgacgccgttgtcgtcggtcgggtacgtgctggtgaaggtcctctgcgccatggccatcgccctggccccgaccctgctcatcggtctcatcgggctgttgaccggagctcacggcacgctgcgggtctgggtaatcggactgggggcggcttggctcagctcagcaatcttctccgccttcggcctggctctcggactgtccctgcgtcccgaggtcgtcatgcacgtccccggcctggtcatcaccggtctggcgttcctgggcaacgtcttcgtccccctcagcgggacgatgctcaccattggccgctggagccccgcctacggcatcaccgcgctggctcgttacccgctcaccaacggcatcgacatcgggggcggccacgactccctgacggctgccctcatcggcaccttctgctggttcgccggattcgtgttctgggcctcccgtcgatttaccaagagcacgggtcgtcagtgacagattcggccgatctccggaaggagcagtgttatgaccaagcccctcattgcagtggtcaccgcgggccaaggagcgcagaagcctcgcctgctcacgccatggctcaaggtccccggcgtcacggagaagcttgctgcatggtccgctcaggccgatgtggacctcgtcgagctcggtaccagggcgaatgcagaaaccttggcagcgaccgagaatgcgcagccactactggtctgtctcggagtcctcgtctcggatctcctggccgaccagaacattgtgctcgcaggacactccgtgggcgagctgacagcagcgtgtctcgccggggtagttgatcccgggacggccgtcactcttgcacgacggcgtggactggccatggcgcgggcctgcgctctccacccgaccaccatggcggccatcattggtgacaatccggatgacgtcctccggcggctctcggaactgggactcacggctgccaacatcaacggaggcggacagattgttgcggccggctccaccgacgcgatcgcggaactggtggcgacccctcccaacgggaccgcagtcaagccgttgcgagttgctggcgcctttcacaccaagtacatgacgcctgcgcaggacgctttcgcccaagctgctcaagacgtcaccttctccgacccgcagcacccgatcatctccaacctcgacgggcaggagatccggtccggcaatgacctgcgtgaacggctgattgcccaggtgaccgcgccagttcgatgggatctctgcatccagcagatcgcggatcgtcagccggaactcgccctatcggcccctccggggaaggtgcaggcgtcgctcttgtctcggcagatcccggacctcgcgacggtctgcatcaccacaccacgggaggcagcccaggctgcacagcggatcgaccagtccgtatccgtccttcagggggcatgatgctcatccccgagtacttcctcacagcctgttcggaccatgctgagcgcctggcgatcatcacccacaatgacgttgtgacgtgggccgaactggcgactcgcgtcgacggttttcggcgctggctgcgggaccatggcgtgcaccgccaggacagggtcgttctccagacgccaagcaccgtaggcacggtagccctcatgtgggcctgcctgctcgacggcgtgacgatggtcccggtgcaccaggacctcactgcctcccaggtgcagcaagtcatcgacgactgccgtccagctctggtgtgtggcagcccggacctcgtccaactcctcaactcccccggaatgaagacaagcacacctccaacgcggccggagtcaacgagtattctgccgtccttgtcccgggtcagccccgatgaccttgcgatgctcatctatacgtccggcacgacgggtctcccgaaggggatcatgtgtccccaccggcaggtcgccaccgccgcacggatcgtccatgactgtctcgggtaccgcacggacgacgtcattctctgtcgcctgccgttgtccttcgactacgggctctatcagattctgatgtctgccatctccggtagcgcggttgtcctgcgggacggaggcgcgcaggaccgcaacctggtgcgcgacatcgcccgtcacggcgtcactgtcgttccagtcgtgccgtccatggcgtcaatgctcatcaccctgcagcgtcgtgatcagttgccgaccatcgtcagactgttcacgaataccggggcgcgtctggcacccgagaccgcgaaccagttgctcgcaagcttccccggctcccgctatgcgtcgatgtatggcatgacggagtgcaagcgcatctccatccttccggtggaggagtacgagacgcatccggacagcgtgggaagagctctgcccagcactcacgtcgagatcgttgacgctcagggagttccggttccggcgggcgagcacggggagatcacggtgtccggcccgaccgtgatgaacggctactggcaggtgccgaacagtcccagtggacgattccgacccagcggccacggcctcactctgttcaccggtgatcgcggctggatggatgaggagggacgtctctacctcctcgggcgcgacgacgagatcgtcaagcatcacggcatccgaatcagcctgcaggagatcgagatagccgccgaagccgcgccgggcgtcgacgcagtcatcgctctcaagccggcctccgactcggcccccattgaaatcgcctactgcggcagcacgagtcccgagaacctggcccgccatctcgaaaccgtcctggaccgggcgcgacgaccccaattcatccaccaactccagcagatccccctgacccgtaacgggaaaccaaaccggtcagcagccgccgaggccatccgctcaagggcgtgacggcgaaggccaacacccacagacgaaaggaaaccaccatgacccaggccgagttcaaccagttcatcgagtccacctgctccgcgacgatcgtggatcccgaccgtcctttggtcgatcagggcatcgactccctcggaatgctcaccctcatggtcgctatcgaggacagcctcggcatcgaactggatcccgagtccctcgccgacggtaggggttccacgccctccggtcttctgtcccttgtcgagcagccgaaagcgacggtgtgacgacatgacgacgatggttccttgccgccgtgtggagatgccgcaactgttcgaccacatccccggaagcatctctctctcaggagggctgcccgatctgagcgtgctcccgagcaatcagatcgccgaactgacgtcccggatcatgcgtctcggctcaagaatcctcctgcaatactccaccccttcggtctcgtcctccttggtgccggccatcctggacctggcggaacgaacatgcatgtcaccggatccgcggaatctgatcccgaccgcgggttcccaactgggcctggccatggtgatcaatgcctttgacggcgatgagatcatctgtgactgcgccacctatcccggggcgctggccgccttcgcctctgccggcgtggaaacaacgggggtggccagtgacgaggaggggctcaacccagacgcgctcgctcacgccgtcgcagagggtcgggccaatggccgccgcatcgcagccgtctacaccacgcccaccttccagaatcccaccggctccgtacagtccgagaaccgccgtgcggccctgctcaaggtgtgtgctgacaatgacctcctcctcatcgaggacgatccgtacggcatgctgtccttcgacgggcagacgtggccagctctgaagtccatggacccacagcgcgtcatctacctgggcaccttctcgaaggtgttcgcaccgggcgtccgttccggctggatcgatccgcccgccaatcttgtcgagaaactccgcgctgtgtgcgagatcatgacactctcgccatcagccctcaaccaagcgatcatcggcgagtaccaccgtcgtcacggatgggacgaactgttggagggctatcgcgcctcctaccgcgaccgagcccgtctcctcatcggggctctcgaggctgaactggcaagaacgaattgcactggcacgtggacctggcgtgaaccacggggcggcttctacctgtggttggagaacgtcgccagcaccagcggtatcgacgttgcgcgtcgcgccgccgacaacggagtggccgtggtgcccgggaaacacttcgacgcagccggacacgattcgccgagcctgcgggtgtcgttcagcaattcacgcccggctgatctggtcgaaggagctcgtcgtctcgcccgtgcactggtgggagaggacgttcagaaatgactctcgcgacacgcaccgccaccgacaccctgcagcagaccttgccctggggcacccacgaacgtctcgtcttcgggcgggcgctcctgcgcagcaccggcttcccagccgaaggcttggccctgctcgactccgacgacatcctccccctcctcgactcctttcttgccggggacatcgacagaactcacttcgagaaggaatacaccagtcgcgaggagtccggcgcaagggcgctcatcaacgtcttgaaggacgatgcagtatcgcgcgccatcgcatggcagaaccccaccgcgtggaggtccttcgaatccctgtcgtccacgagcggaatcaatgcttcgactcggcgcaaggtacgccaactcgccctctactggcaacgttactgttccaaggctgagaccattggatacttcggcccgttcgcctgggccgaagtcgacccggaggcctctgcggtcgaattcatctcctccgaccatctgatcgaccgttcccacgtcgcaatggaggcgtgggcggtcattgagatcgggaaagccctggcatcacgggccgaccttcagtggtggatgccaccaatcctgtcccccgccgtcgacctcaacagggagagaggcaccgtgacggtggctggacaccagccacgacgggtccgggaggacgaggcacgagttctcttcctgaccgacggcacccgtcccgccgcccagatcgccaagagcctcgacatggagcccgagcggttgcgcaggatcctcgtggcccatgaacgtcgtcacaccgtgatctgggacgccaacatccctgtctcagtgcacgcgtgggacatcctgcacgaacgcattgcccagatcggagacgctgggctgcgagatgaggccactgctgttctcacgaggttcgacgagcttctggaggtcatccgcaacattcccgacgcccggtccctgacggaggcgacggaatccctgtcccgtcttttcgaaaccgtgacaggaacctcttcgaacagacgtgcgggccaggcatatgcagcccgcagcctgtgctacctggactgcacccgcgccggaaccgccaaggttgggacccggcttctcgaagccctcgacgcccccctcaacctcgtcctacaatccgctgactggttcgcggcgaccttggcaaaggaatacaccaccgaaatcacggacctcgcaaatcgaaagcagcgggcctcccaccagccactgaccatggctgatgtctggccgtccacgatgtcgctgttctggggggactcaccgtccccactgcagcgagccgtgaccgaactgtcacggcggtggagcagagtcctcgaggggctgcagccagtcgacggtcgcatcgacacgacatcgtccgctctctcgggcgccgtggacgagcagttccccgtgtgcaccccgattccagaactgtcagtgcacagcccggacctccaggtcatcacctcgagcactagcaacatcgcctccggacgagtcactgcagtcatgggtgagctacatgcctgtctgagcagtctcgacatgccgttgctcgagtggtcgctgccccatggttccattcgcgatcgcatcaacaccgcgctcaacctgcgacgtctggttcccttgttccccgagacatggaggcgcaacaccggccgcatggttccagcgacggtcggagtgggggatcgcgcaatcgggttcactcggacggccgatcaagaccgtgcgaacacatggtcgatgtcggcactgctgttcgagcagaccgaggacggactcatgatccgtgatcccgatggcaggctctggaccatcgcacaagcgtggagcgtgcccatctccatggtcgccgccgatgcgttcaagatcgggctgcccggctcaccagcccctcggctcaccattgacaatctcgtcgtgttccgtcgtacctggaggtttcccgctggctccatcgacatcatgcacggttcagccgccgagaaacacgctcggctgagggagtggcaggtcacgaatcaccttcctgaccacctcttcgtcaagttcccctccgaacccaagccgatctacttctccttcgagtcccccgccatggccacggtcttcacgcgatcactgcagcgcgacgcccgagagaatccagacagtctcgtgacgatgtccgaagcactgcccgagcctcaatcctcatggctgcacgacacccggagccaccactacgtccacgaattccggctgcaactgaccaaggagcgacatgacgaccacagttgagacacatcccgaaacacgtggcacaaccgcgacatccatctccaatctgatcggtcacacccctctcgtaagaatggaccatctgttcgacggcctccccttcgaggtgtacggcaagctcgagaagctcaatcctggcggaagcatcaaggatcgagcagcacaatccatgatcgaacgggcaattcgacggggtgagatcgtcccgggccgtacgaccgtcatcgagtccagttcgggaaatctcggcatcgccgtggcgatactgtgccaggagcacggcctgaatttcatctgcgtaaccgatgccaaggccacgccaacgaacattcgactcatcgaagcgttcggggccactgttgaggtgatcgaagaacctcatcccgagagtggcgaattcctccccatgaggctcaagagggtaagagaactgctgtcagagattccagatgcatggtggccgaatcagtacgggaaccccgacaatccggcggctcacgagcggactgtccgcgagatcatcgaggcaatcccgcgggttgacacgattgtctgcgcgaccggctcgtgcggaacccttcgcggctgccacgaagcattgcgaaagctgtccccacgcacccgactcgtcgccgtggacgccaagggcagcgccatcttcgacgaggcaggagcaccccatccccgctgtgtcccgggacacggtgcgtcagtgcgaccgccgctgtggcgcgcggggctcgccgaccaactggttctggtctccgacgcggactgcgtcgtgggatgccaggaggccctgcgcaccgaggctcttctcctcggcggatcctcgggagcaattctgacggccattcaccgagtgtctcccacgattcccgctggttccaccgtggtgacgatcctccccgacggcggcgagcgctacatcgacaccatctacagccgctcgtgggtcgactcacacatccccgggctgccctctctcgccgactggggggctcccaaccccgccaattcgtatgacctgaacagaagtgcctcatgaagctctacaccagagagaccgtcgaaactgcgcttgtcgggcgtcatggccaggttctcagtgccgtacagagtgcatacatgctgcattcgacgggagagacatcgctgccattctcaaccttcctccgcccggccgggtatccgaacgatcggatcatcgcacttcccgcccacatcggaggcgacttcgacatagccggtatcaagtggatctcatccttcccggaaaacctcgaccggggccagcaacgagcttcctccgtactcatcctcaatagtctggagacgggatacccgaccgccctgctggagtccagtcagatttcagcaacgcgaacggcagcatcagccgccctggccagcgccaccctccatggctccgaagaccatgtcagcacgattggcatcatcggctgcggaacaatcaatcttgcaacgatcgactacctcttccacgtgcacccccagatcaacgaggtcctctccttcgatctgaggcgggagcgggcccatgagttctcgcacctcgtcaaggcttcgcacccagaggcccgggtccgtgtcgccaaggagcccgacgagattctggccgcaagcaacaccatcgcgatcgccacgaccgactcgagtcattggttggaccttccgccgtggcacgggccggggcaccaagtcgtcctgcacacgtcgctgcgagacctgtcagtgccctcgatcctggcagcggccaacgtcgttgacgatcctgatcacgtctgccgtgaagcgacgtccttggatctggcaactcagcagaccggcaaccgggacttcatcacggggagaatcggagacctccttcttggcgcgccgctgtcctcaagtcctgactcccgtgtcattttctcacccttcgggctcggcatcctcgacctcgcagtcgcctccgtcgtcattgctgccgcctcctcttcagcagtcgagatcaatgggttcgaccccgggaaacacgccacaagcatgattgaggtgaatcgatgaccaccacacagatcaacgacaacacggccgttctgcgcgacgtattccccgccggctccgtcgcattcgtgagcggtgcctcacgcggaattggcgctgcctgcgcgacagcccttgcggccgcgggatgcaacctcgccatcacttatcgaaggaaggagaacgaggcggcacaaatcgccgaatccattgaagccatcgggcgccagtgcatcacaatgcagatggacgtaaccgatgagaaccaagtgaccagagccttccgcatcattcgccagcattacggacgcctggacgccgcggtcttgaactcgggaatcaccagtgacgggcatcttgcaacaatgagccgctccaagtggagctcggtgatcgacacgaatctgaccggaaccttcctctgcacgcgcgaggcgaccaaggccatgtactcgtccggtggctcgatcgtcatggtcgcgtccaccagtggagttgcagggcgaccgggccaggccaactacgcagccagcaagggcggaatcgttgccatgatgaagacgctggccccggaggttgcggcaaagaacgtccgggtgaatgcggtggcacccggcttcattcagaccgacatggtggcggccgttccaaaagcggcactcgcccaggcaatccaacacatccccatgggccgtcttggcctggcacaggaggttgcgtcagccgttaccttcctggcctccccgctcgccgcctacatcacagggaagacccttactatcgatggcggaatgatcaacggctgaccccaggacccgcacacccccagtaccgagaaagaaacaacaatgaccgagatcacccacactgccaacagcatccgaacccgcgccgaggaacgttccaacaaagcttggcgcctgaaggaggagatcatctccaagctcggtctcgagaccaagccagaatatgtctcggacaaccaaccgctcttcggacgtggccttgagatggattcccttgacactctcgaagtcgtcgtcgccgtcaacaatgagttcggagtctcggtcaacgacgacgacgtacaggcgttcggctcgatcaatgccatggtcgatttcatcgaggtgaacgagaagtgagttctcttgcgctcgaggcgccacccaaggacgcccgtaagaaattcgcctacgacagcgatgccatcaagacgatgctcccacatcgttggccgatgctcatgattgatcgcgcctacgacgtcgtcccagggaaatcgggcaaaggcatcaagtcggtcagcgtcaatgagccgttcttcgccggtcactaccctgaccattccatcatgcccggcgtcatgatcgtcgagtcgatggctcaactcgtggccgtcatctacgtagccgaggccattcagaacaatcccggcatgacgtcgcacgacgcacgttcaagcgttggttatctcggcgcgatccgtcagatgaagttccgacgcctcgtcactccgggcgaccaactcaccctccacgcccagctcggcgagaaagtgggggctctgcgcgaggtttccgtgagagcactcaatggccgggatgtcgtcgcccagggggaactcgtcgtcaccgagcggtgacacccagccacacacgagaaggaagtcccatgatcgttcgcccctacaggccacgtgatgcggaagcgatcatacatctctacaacagccattccgactcccccaatccagtgtcgggagggattgttgaggaggagttccagagggagctcgaagaacgtggttcgacagtgttcctagtggccgaggaggccggatccattgtcggcacattcgggatgttccgcacgaatggccgacacaccatggccgatgatgaagtcttcgccgacatgttctatgtcaccccgtcacatcgactctcgacagttccgggacagctaatcactgaagccatcagcgagtgcttcatccagggcatcaacgtgatccgcctcaccgtgaaccccgcgaacatctccgcgctcaaggtttacagaaaagtcggttgtgcctgtctcggggccaccgatgcaggcgaggacgggaacattgagctgtacaacttcatccctctggttcttagggcaaccatcaccaaactcgaccacgattgtattcgagccctggcggacatgacttcgttcgcctgcatcaccgagggacgtccacttgatctgtcccacgacttcatcgtggacgctggacggaagatcgtctcccacagcatccagatcgggcgttcaaccatccacgccatggtcgacacgggctcgaggaccattgtggaggccaccctcgacaaccgcgactgggatgctcctcgccagatcgtcgcccccaccccctgtcagaaccggcccgaggaacagcgaggcaaccctgtccggctggtgcacaagaagcttgaggtcaccttcaacgaaggagtcattgagatcagtacgactggccactggggcccggtcctcgcaatgtcctggccctcctccgtctcgcaccgcgctcacgggtggcgacagggccccgccaagtcgtatcgatgcgagcttctcgagaattgcctcgtcctggatgacgaaggaggagtgaaatgcaccatcagcctcaatgattgccaagtcgcgatccggatggatggtgccccaaaaacggaattgagaatgtaccagtggtgcagcctgcgccagggctatctgacggctgacaccggcatcacgagcttcaaccgggcatccagtgggctcggagtcgccgtccgggactcgtccgagattgtcgccgcgggccttcccgtcatccctgacacaccgatcacatggagtgagggtgacatcacggttcagctcgatccctgcggccgcgcctccctgatccactcgaccctggtggaccgaagaatccacttggacgagtctggctcggcaagtctcaccatgaccgtgtttggtgattcccagccccatcgtgccgacaccgtcgagctgcctcccctcgcggcaggcaccgacaggatcgtcctcaagccggctgccggaggcgtgaccacatggcgcttgggcgccaccaaggtgctcaagtcaccgtggccacacgcccgcgcgctcgggcccaatccgatctggcgagccggcctgtgggtcagtcacgagccggatcgccacgaccgtcgccaaggaatggggtggggtcccgatcatcgcagttggaccctgtcggaagacaccatgaccagtactgacgggacactctcctggcgcttcagcggctcccccgacaccggctggacggtcgacgtcacgacgagcaacacgcacggggagaccgtcgtctggctcaccccggactgcccggcgggcgagaggatccgcacgtctgatcatgccgtgacgaccatgcttgacatctcgaagccatggcagcgctggaccacccgatgcgcaattcctctcagacacgggaagtggttcctcatcgagcctgatcatgacctcactgattcccccgaaatcctcatgcgctctgttcacggggtcctgctcgtcggctgtgtcggacgagcccactccggatccgcttcctggcgctttgccatcacgtcagaactccccacctccaacccaagaagaaacgactacacctcagccgcctgaacccaaccagttggaacacccactacagaagaaatggagcaccaccatgtccatcactgagcagtacaagacccttcgcacctcggtcggcctccacacgcctaccggtcccctggtccgtatcaccggtgatgatcgtctcgagtttctcgacaccttcctgtcccgcgcctcggacttcgtggaccccgacaccactcgggagtgcctcgctctcaccgaggacggccttccgctgacgatcttcctccacatcgagcgcgaggaggagtcatggctccttccccgcaccgccatcgatgcggcgaccctcgccacgtacctcggcaacctcgagaccgatggtgacctgtcaatcgagattgctccagagggttggggagctgtcgctgtcgaggggccgctgtcgtggcagatcgccgaaaaccttctcgacttcgacgtggctggcctcgttcttcacgccgtcacggacgtcgtcgttcccggggcccccgagggatcgaaggcatggctcgcccgggtcggaaccactggagagtacggctacctgctcgtctccaacgttcccgacctcgcccgcacttatctcctcagccgcgccacggagctgggcggtcaggcagtcgacgccgatgctctcgcacgagtccaggccgaggccgggatgccctattacgcgatgggcgtgtgccacctcgatgtcgccgggggtgacctcgcctggctcgtggactggcagcgcatcggcgagttccaaggatccgagaatctgcccacacccgtccgagaccagcgccgactggccgccatcgccctgcccaccggcaaccgcccggaagctggtcagaccgtcgctgccggggatgaggagattggaatggtggtgtacgtcaccccgtccgccaatcccgatgaggaactcgcgttcgcacttctggatgctcctttctggactcccacccttccgttgaccgtcggtgcccacgacgggaccacggtcaccctgccccgcgtcgtggcagcctccagcctcaacaagctggggtgacagcgatgacgatcactgctgagaacgccaccacccgcagcgacattgcccggagcattgcggtgaccggcgtggggctggtcacggcacagggtgaccataccgacgagtgctggaccgaacttgtcgatggggtttgcggaatcaccatgaacgtcacgttcgatgactctggcaccacgattccgtgtgctggcgtggctcccattccgaactctgattcgatcgaccgctgttacctgctcggcgtccatgccatgcgtgaagctctcgagatgagtggcatcgacctggactccgtgggtcgtgatcgcatcggactcgtggtgggctcaagcctcggcgcgatgcccaccttggaggcggctcatcgccgggccattgagaccggcgtgctcgatgccggattggcggcagactcccagctccactgcgtcgccgaccacctcgccgctgagttcgacatccgtggaccccgcgtcgtgacatcgaatgcgtgtgccgctggtgccgtggcgatcggctacgccgcagaactcctctggtccgacgatgtggacctggtcgtctgtggcggtgtcgatccactggcccagatctctgccaatgggttcacgtgcctgggagctctcgacaatctcccatgcagcccgatggccggttcctccggtctgactctgggcgagggagccgggttcatggtcctcgagagaacagatgcggcggctgccagaggccaggaggtgatggccgaaatcgccggctacggcacaagttgtgatggttaccaccagactgccccggacccgggtggcaatggcgcccgcagctcaatggaggccgccctgcgctcagctcatctcaagccgtccgacgtcagctacgtcaatctccacggcaccggtactccgaccaacgacgccgtcgagccgaaggcactccggtcattgttcaagtccgatgaccttccccctgtcagttcggtgaagggcgccatcggtcacactctcggcgctgctggcgccatcgaggccgtgtgctcgatcaaggccatccacgagggggtcctgccgccaaccgtcaacaaccgcgggcaggcttcccgaactggtctcgacatcgtgccggagtgcgcacgcaaggccgctcccgacgtggtcatctccaactccttcgccttcgggggcaacaacgcatcagtggtcatcaccgcacctcgaggaggcgttcactgtaccgccccggcgcagcttcgcgaggtcggaatctcaggaatggcagctctggcgggaaaggccgccaactcggaggagcttctttcggccctgtcagaagattgtccaatctggatggccgatgagaagacctgggaaggggatgctgtccaaaccggccatgtggacatcaagcgcctgtcccgcacaatcaacccgtccaaggttcgtcggatggaccccttgggaatcatctccagcgcggtggtgactgatctgtatgcccgacacgggaagctgagccgcaaggatgccgaaagcacgggaatcatcttcgcaaccggctacggtcctgtgacggcggtgacgcagttcaatgacgggatcatccgccacggttccgagggtgccaacgccctggtgttcccgaacaccgtggtcaacgcagccgcaggccacctcgcgatgctgaatcgctaccgtggttacacggccaccttggcatgcggtggaaccagttcactcatggcgctgcttctcgctgctcgcgtcgttggccgcggcgctgcggatcgcatcatggtcgttatcgctgacgagtttcccagcattgccgtccaggccgtcgcgaagcttcctggctaccgacacagggttgatggttccggagccgtgctctcggaaggcgcggtatgcgtcctggtggaggccgtcgaagtcgccgaagcacgcggtaccgcccccatggcgctgctacgcggcttcggatcccgtggagagtccgtgggagtcggtcacaccgcatccgatggacgggcttgggccaaggccatggccgctgcactgggcccggccggcctgactgcctccgacgtgtcgaccgtcgtggcggcatcaagcggacatcctcgcgtcgaccgagccgagcaggcggccaggcggatcgtcggactgtccgcaaccgctacgaccttcccaaaggcgattgtcggagaaacacacggatcggctgccgggatcgggctgttcggtgccctgtgcggttcgaggtcagccgcgcaccagaacatccttgtcaacgccttttcccacggcggtggttatgcctcgatggtggtggagtcactgtgaccacgacgcttctgccacgggttgcccagccgggaccgggcgtcagccatgtcgacaccgaccgtcccatcgagtgcatcatcacccaccacccccacatgccgcgtgatcgcggaggccacgccacctccgtgtcaggcaggtacttgctgcgccaagccgcagaactcatgctcggcacggatcctgcgcattgccccgtcgtcgacccttcgcggcgctggtactggcccggaatcaatcttcacggttctgtctcccatgtcccgggctggagcctgacgacgctgagcaccggcggccacatcggggcagacatccaggacttccgggagcgtcccggcgcaatggcattcatcggtgacctggtcaagctgtcgcgatcggcgtcactccgagaattcgcggagtgcgaggccgtcgtcaaggtgtccgaattgactaaggagacgttcgggcacgtgcgactgcccgaatggacacccggatggcgccacgttttcgaggactactgggtctggagtctcgagatgcacgggatgggagtcatcgcactcgcatccgatctcccccgagccattcgctggtggcggtgcgacgccgatgcccgtggccgtctccaggctctccgacccataagcagtcttggaccaggaaggccgtcatgagccggtactcacgtcgaatctcaggcatcgaacgcggctatctcaacgccgcaacccggggcccgcaccccaccatccacacgatgatcgacttcgagggccgcgtccccgccgactgttggcggcacgcatccacgattgcgtcggccgccaaccctggcatgacagtggtccggaggtcgggccgatggacatccgatccagcgggctgtccggttgtgttccacgactggaccgcggaccccaacgacgttgccgacttccacgctgacatggatctcgtgacgggaccatcgtccacgctccacgttttcgagggggcggaacgcacccgaatcaccttggcagcaagccatgccgtgaccgatgggcggggcatcgaacgatttctcgtcgacctgcttgcagcgttggacgagcgtgaacccattggaagccccgacaccctgaccgatgtcgatatcaaacgatccttggagaacagcatcaagccccgacgccacctggccgctgtgcccgccgatgtcctttctccactgggggggaggaagaaccaacgtatatgggcctccaggacgtggcacagtgccccgggagccatgagcggaagaatcgctgccgctgtggccgagatgatcgaccacgccgcaatgatcatcatcccggttgacatccggcggcacgtcccagaggtccgatccacagcaaacctaagtgcccaactgccagtgatcatcaccccgaaccagcgctggcaaagcatccatgggcatctgctcacggaccttgctcgccatcgagaccttgcgatcatcagtgaggatttccgccacaacaatccgttcgcatcgaccttggaggaaagccaggccatcggcctcgatggtgtctatccctgtgccgcaatcatctccgaccacgggaagctcgacctttcaaggttccagaccttggaactcaccccggtctcgatgcgaagcctcccgatgctcgttccctactccgcaatgttcatcagcagttgcaccgtcggcgagaccaccactgtcaccatcgctcatcgcgctgatgacgatcccgattccataaacaccttcttccaccacatcgaatcccagatgtccatctgagccacgtcgtccctggagagcaaacatgaccacccaaaatgtcatcaccccgccgcgccccgtcacctcccatgccacggcgaccaggtccgaggctccaccgcgaagcgtcatcagagccatggccatctcgatggtcgcgaccctcatggtcatgctcgacacgaccgtcgtgaacgtgtccttgagcgcgaccaccgcccgcttcgggagcatgggcagcgtgcagtgggtcctcacaagttacctacttgcactgtgcgcgacgatgacggcctccgcctgggtcatcgaccgccttggtccacggctcaccttcatcgcctcaatgaccatgttcctcatcggctcggtgatgtgtgcactgagcgattcagtgtggcaactcgtcactggcaggaccatctccggtgccggagctgggatccttgttccgacagcatccgtcctgcttatccgtggcatcccacgcgaacaacttggcagggtgcaggcactgaatgggagtgtccagttgatcgctcccctgatcggcccgactgtgggcggtctcctcgttgacaggtgcgggggctggccggccatctactgggcgaacgtccccgtagctcttgttcttctgattgaggccgtccgcgtcgatccggacgaaccacacaccgctaagcgccgcctcgatgctctcggcctggtctgtggcagcaccgcgatcgtgctgacagtgcttggtgtctcactcttcggcaggacgtcgcgaaacaccaccttcctgcttacgatcggcgcgcttgcagtcctcgcatgggcgttcttcatcacccacatccgaagggctaccaaccctctgcttgacgtttccctgtatcagaaccctgtctattcatggtccagcttcaacgtagcggtgcttggtttcggtctctacgcccccatggtcgtcatgcccctctatctcgaggcgacgcgccacctcactgccgtccacactggtctggtgatgtcagtggccggcgtcggcgtcattatggccggaatcctgtgcacgaagatcatgggccggatcggtggaggcctcacgatgacagttggcataactctgagcatcatcgccactctgcccctggtccggctgacgaaccacacctcctacatactcctggcagtctgcttggccttgcgtggagcaggaatcagcctgacaatcgtcccagccatgacacgggccttcgagtccatcaagaggacggccatggcggacgcctctgcacagctcaacctgttgcagcgaatcggcgggacaattgcgacagcagtcatcatcgcagttatccaccacgaggccatgctcacccgcggactctcccccacagtgttctcgcacgccaacgtgtggatcctcaccgcgaccgccgtcacccttctgccggccttcgcgcttgcgaaggccgaaagacaacagcaggatctctgagcaccgaggagtactccctcgtagaccctcctctgatctaattgggttcgttccaagtgtgtatctcactccggggagccccgattgctgaaccacatcccgttcaccctggcgagtccctcgtggtacgacgtcccctgggcgcccggatctccgtatctcacaggagatatctcggtcctgccagcggactcgccaaggtggacgacgaccatccggggtccttggcaaatccacatgccacctcgtccgacccttccagaggtggggtggaaagtgcatgtgtctgccaagccatcggaattggaatcggttgcctcagtcgtagcactgtggtgcgtacgccacagcgtccccttcaaagtacttcgcacccgaggtctcgttcacgcgagtcaagtcaagtatgcggaccgaagtcagagcggcaaggtctgcacctgctaccccgacggcgagagccttgagcacttctgctccggtcttgccgagctgcttcagaacgtcgattcacctccggtgtccggcgagctgcgagtcggatcctcccctctgtggttgcgtcacgggagtttccgagaggcatgggcggtgtcatccacaggagtaccgttcccggtctacccgggaacaacacatcctgatcgtcgaggccccgcgcccgcagaatccgatcacgacacgccgtggatccggaggctccgtcggacgaatcgccccagcacggttcttcccatcgacgatgtcagactcctccaccgatcaaatgctggcggcgtgtatcaggcaacatggagagacggcacatcggtagtcgtcaaggaggcccggcacctgtccggacttgatgcggcgggtgtcgacgcccgagtgcggctgcgtcacgagtacgaggccctgagaagactggacccctatcgggccgctccccatcccattgatctcattgagaccgaggacggctcgttcctgatcatggaattccttgacggaatgacagtccaccaggagatgtcgaggttccatcctctgattagtaggcgacctcatcggctatcgatgaccgatttttcacgctggtgccgagaggtcgaagatcgcttgaggaatgtcacgagggtcatggccgggtgcggaatcgttcacggggatcttcatcccgcgaatctgatacatgtcggccatgaggttttggttactgactttgaatcctgctcaatcgacggggtcgccgtctcgtcagggatcgccgctccctggttccagtcggacgacacgattcccgatccggcgacgactgacgatctccacactcttctcgtggatccgacttgcggccccgcgcttgtcccccatccaaatcttcgcgcgctcatcagccaggccgcagtcgaggacatgatgggaaatccgactggtttaccacatgcctggaacctcgaggacatgacaagcgaactcgccaaggggatccgggcatcagccactcccgcacgagccgaccgcctctttccctcagacccctacctgttcgggcatccaggttcagaattcggcctgatgcatggcgccgccggaatcatggctgctcttgccgtgactgggtacggtgttgacgcgaatcacgtgacctggatgaaggaccgcttggccacccgcccgaccctgctgccggggttggccaacggaatcgagggaattgccctgggtctctccctgtgcggtcagaacgacatggctgcatccctgctccaccagtccggaattctcacgatcacaacgaacggatcgactgacctcaccctcggtactggtatggcgggccgagcgtgcgcgctgcagtccctctcacaacgactgtcatcgaaatctctcgcccacgctgcatataccctctgggaacaactcgccgtggctgtgcggaacactgatgtggccttgccgaacggcctgttctccggttgggagggaatcgggctctccctgcttgcctctcccctgccggatcgtcatgatctcgcccgccactcactccgactggccctggccacgacaacgattgttgacggtgcgctcttctcaggcgagggacagatccgatggccatatctggggcgtggtcccgcggcatgtggcccgctcgccgccaggcttgatgatgaccagacggccaaggccgtggcacagacctgtcgttgtcccctgactgagtcatccggtctccacaatggccgcgcaggtctcctactcgtcctccgccagctcgtgggagaccaagacgacgccgttcgccgccacctcatgagactgtcgtggtcgatggaccgtcgcgaggaaggcacattgctgctgggtgatcatggcctgcgtttctcatccgatctcgcgacggggtcagccggcgccctcctcgccctgagcagggacccatggcggaacatgacacgaatgctcggaatatgcgatgacacctgtcatggcccactagtgacagtttgatctagcgccgatagttcacaactgaaagactccaaacatcgaggaaaacatgctgagccaaaacgccttggcaggcgtggctcgtttcaccacgatgaacaccaggagacagaatgtccgttgaggccatgcaatccatcgagatggacgaggaaaacagcgccagccagacagtttgcgcttgttacagcttcttctcgtggtcaggatgctgcgtagtctcccaagcggtggaagcatcttgatcgtgtgagacgccgtcgactaccctgtcccccgtggtacgcacacgccccgtcctggacagtcccggaagaccgctcatcgcctccggagtcgtcctggcggtcctgctcatcatcgcggtgatgacgatggtgcttcagcgcgaccccactctcacccccggacgccgcattctcggtatcgtcctgtccacggtccaggccgtcggattcatgtggctgcagacccgcatggttcgtcacggcaagggttcgcgcaacatgcgtgcgacccttggaagggtcggtttctgggccacgtggggactcgtcgcagtgggagtcgtcaatctgtggctgaccaactcgtggaccctcttcggggcctccgtcgccacgcccctccttctcctgccaggggtgtggagtgtggtggccaccctcgtgaccctgatcgtcggtttctccgacctcgtggtcacccacacctcgccactgacctcagccacggtcgtgctggtgaccatcgcggtgtcggtgaacctctacgcattcacgaagctgtcgacggcactcgttgaactccgctcctcccaggaggagatcgcccggctgcgcgtggacgccgagcgtcaccggatatcgcgggacctccacgacatcatcggtcgcaccctggtcgccacgtcgatgcgccagcaggcggccctccacctcgtcgaccgcgacccgcaacgggccaaggaacagctcgacgccgcccatgacgcaatcaccgaggggcagcaccagttgcgttccatcatccaggccgagatgagcaccagcctccccgacgagatcagcgacgccacattcctgtgcgaccgactccacatcgacttccgcatggatgaccgcggcagaccgcacaaacccttcgactcggcggcggcggcggccctgcgcgagggaatcacgaacatgctcaagcacagcgcggcgggctactgccacgtcgccatctccccggacctcctgaccgtcaccaacgacggttgtccgcaatcacctcgcccctccaccacaccgggcaccggaatcgaccatctccggtcccagatcgaggcgctcggtgggtcggtgacgacgtcgcggccctcgcggggcaccttccggctccgctgctccttcccgacccggggggcgtccacgaccacacccgcgaccgaaggaggacgatgacgacgagaatcctcctcgccgaggacatcaaactggtggcagaggccttcgaggcactgctctcggtggaaccggagttcgaggtcgtcgcacgggtggcacgcggcgacgacctggtcacatccgccacccgcctgttccccgacgtgatcctggccgacatcgacatgcccgggatgaccggcatcgaggccacccgaatgcttcgcgacaagggataccgcggcagaatcatcctgctcaccgccctgccgggaagcgggcacctgcacgccgcgatggctgccggagccgacgggtacctgctcaagtcgatcaccgcgccctccctcatcaacgccatccgggcggtgtgcaacggccagtcggccatcgacccgaacgtcgccgcggtcgccatgcgcaagggaccctcgcccctcaacgaccgggaaaccgagattctgcgcctagtcgccgacggttcctccaccgcgcagatcgcctcgcggctgtacctcagcaagggcaccgtcaggaactacctgtcgacggcgatgtcgaagctcgacgccgactcacgcacagcggcggtcacgcgggcacgcgaggagggctggctgtagcaggcgacccgctcagcccaccgcccctcagcccgccgactcctgacgcacggcctcctcgaccgcccggctgagcagggacccggccctgaccatcgacgtctccgggtccggctcgaggtcggacaacgcgatgatccggtcgaacgcggaccgtttctcctcgggcaggtcacagcgtccgcacaccgcccagacgggcaccccggcgtcccgggcgatcttgcggatggtgtcgggaagcttgccgagcagggtctgctggtccagccgcccctcccccgtgacgacgagactggaggcggagatccgcgacaccgcgcgggaccatcccaggacgaccgccgcgcccgggcggtacctggtccccaggcacatcagcgcccagccgacccggctgggcggctgcgaaccccctggccaccgcccggcaggcctttcccgaactcagcgaccccttgaaggagtcgacggcaacgatgaccggcgcattcggatcaggacgcatgggatcagcatgtcacgtcgatacggagcagtcgcgccgcctacccctagactcgggggcatggtcaaccgagtctacctgtccctgagcgttctcgccctcgtgctgtgggtggtcgcctaccgtcacatgccgggctgggccgcgggcatcaccctggtgggcatcgtcgtgctgtcgctgtggtgcgagtggtcgcgggtgcgcaccctggccaggatcggcaagtcccgccagcagggcccccgctcctcccgaggacgcaacctgtcgtgagcaatacgattcccgcagccctccaccccggccctgacgaggcc

SEQ ID NO: 428 - DNA, 26620 bp, Propionibacterium acnes
ccttgtggacaccacgtcatccacatgacttgtgtcacatgattcccggaccatcatcaagcagatgctcacccaactgtaatgatttctgttctgaatctggacatgctctgacctgcattcaatgatcaattccgtgcgatattccacaacgcacggggaggtcgcagacaatgacaacagaaagcatccccacgcggctgctcgtgtggcacgagcagaccgatccgaccaagctcctcaggatcaccgacgcgatcaggaggggggatccccttccccccatcgaggccatggcgatcggccacagattcctcgtcctcgacggtgcgcaccgggcccaagcccaccagtactgccatcgatctgagatccgagcccgcctccacaacctccccctcagcgcggaaataccaggctggagccactccataccccgcgatgcagcagcgaaactggctcacctactcctccccgtggacgctctcggtcaggcggaaatcgtcctgcacggggtgcgccgtcaggtggggaccgcttcacaacgaccgcgcgacatctttctcgcctgccaccggatcgcgcgagttgcctacgcgcatggaatcagacctctcggcccggagttctccaacgctccgacgatcgacgccgccaccatgacctggcgcccgccgaacgtgggcacgttgtgggccatcgccagcagtctcggacccctgcccgcaactgtgacccggttcgccccgatcctccggcacgacgccatcggggattccgcgatgacacccgtcacctccgccgcgtgacgacccgcgccaattccgccccaccactggatgaggggcagccgcgtggacgatgctcctgttcaggcagggactccatacgagaccaataggaaaatcatgatcaaaaacacaagccctctgaccgtgaaaaatgtctcgaaaacattccgtggctccagcggagaagccatcaaggccgtgcaagacgtgtcattcaccgttgagcgtggtgaggttgtggcattcctcggcccgaacggcgccgggaagtccaccaccatcgacatggctctcggcctcacccgccccgacagcggccagatcgaggtcttcggtactgacccgctcagcgcggcccggtcgggacgctgcaccgcgatgacacagaccggcgggttgctgcccgacctcacgattgggcagaccatggagatcatctcctcgctctatcgtggctcccacatgaatgcctgcatggagcgagcaaggatcacgcatctggccgatcggcaggtgtcgatgtgctcgggaggcgagcgccaacgacttcgcttcgcactggctctgctgcccgatcctgacttcctcatcctcgacgagcccactgcggggatggatgtggaggcgcgccgggacttctgggcagagatccacgaggacacgcgtcgtggtcggacaattctgttcgcaacgcactacctcgacgaggtggacgagttcgccgatcgggtcatcctcatcaaggagggccgcgtcatcgccgacgacacctccgacgcgatccgcaccatgtcggggggttgcaccgttacggcgaccattcccgacttctccctggcacgactgaatctgccgggcacccaactcatcaagcagggcggcgcacgcgttgatctgcaccatcccgattccgatgccctcgcagcgcgagtcatccagctcggcggcaccgacctgcgcgtggtcccccgcagcctcgacgacgccttcctcgctctcacctcaaccaccaaggagtcctgacatgaccgcccaagcgcttcccgcagtcgccactcccaaggcccgccaccgatccgccatctcgctgaagtacttgtggtgcgagatgcgtcgccccttccggcgttcgacgatgctgttcaacctcgccctccccgcagttctgtacctggccctgttccgcaccgtccacaccgccgagctgccggacgggaacttcgcgatgtggatgatgatcggcatcgctgtctacggagcggccactgcgagcaccagctacgcagcctccatctccgtcgacgaggccaacgggtggacccgcaccatccgcctgacgccgttgtcgtcggtcgggtacgtgctggtgaaggtcctctgcgccatggccatcgccctggccccgaccctgctcatcggtctcatcgggctgttgaccggagctcacggcacgctgcgggtctgggtaatcggactgggggcggcttggctcagctcagcaatcttctccgccttcggcctggctctcggactgtccctgcgtcccgaggtcgtcatgcacgtccccggcctggtcatcaccggtctggcgttcctgggcaacgtcttcgtccccctcagcgggacgatgctcaccattggccgctggagccccgcctacggcatcaccgcgctggctcgttacccgctcaccaacggcatcgacatcgggggcggccacgactccctgacggctgccctcatcggcaccttctgctggttcgccggattcgtgttctgggcctcccgtcgatttaccaagagcacgggtcgtcagtgacagattcggccgatctccggaaggagcagtgttatgaccaagcccctcattgcagtggtcaccgcgggccaaggagcgcagaagcctcgcctgctcacgccatggctcaaggtccccggcgtcacggagaagcttgctgcatggtccgctcaggccgatgtggacctcgtcgagctcggtaccagggcgaatgcagaaaccttggcagcgaccgagaatgcgcagccactactggtctgtctcggagtcctcgtctcggatctcctggccgaccagaacattgtgctcgcaggacactccgtgggcgagctgacagcagcgtgtctcgccggggtagttgatcccgggacggccgtcactcttgcacgacggcgtggactggccatggcgcgggcctgcgctctccacccgaccaccatggcggccatcattggtgacaatccggatgacgtcctccggcggctctcggaactgggactcacggctgccaacatcaacggaggcggacagattgttgcggccggctccaccgacgcgatcgcggaactggtggcgacccctcccaacgggaccgcagtcaagccgttgcgagttgctggcgcctttcacaccaagtacatgacgcctgcgcaggacgctttcgcccaagctgctcaagacgtcaccttctccgacccgcagcacccgatcatctccaacctcgacgggcaggagatccggtccggcaatgacctgcgtgaacggctgattgcccaggtgaccgcgccagttcgatgggatctctgcatccagcagatcgcggatcgtcagccggaactcgccctatcggcccctccggggaaggtgcaggcgtcgctcttgtctcggcagatcccggacctcgcgacggtctgcatcaccacaccacgggaggcagcccaggctgcacagcggatcgaccagtccgtatccgtccttcagggggcatgatgctcatccccgagtacttcctcacagcctgttcggaccatgctgagcgcctggcgatcatcacccacaatgacgttgtgacgtgggccgaactggcgactcgcgtcgacggttttcggcgctggctgcgggaccatggcgtgcaccgccaggacagggtcgttctccagacgccaagcaccgtaggcacggtagccctcatgtgggcctgcctgctcgacggcgtgacgatggtcccggtgcaccaggacctcactgcctcccaggtgcagcaagtcatcgacgactgccgtccagctctggtgtgtggcagcccggacctcgtccaactcctcaactcccccggaatgaagacaagcacacctccaacgcggccggagtcaacgagtattctgccgtccttgtcccgggtcagccccgatgaccttgcgatgctcatctatacgtccggcacgacgggtctcccgaaggggatcatgtgtccccaccggcaggtcgccaccgccgcacggatcgtccatgactgtctcgggtaccgcacggacgacgtcattctctgtcgcctgccgttgtccttcgactacgggctctatcagattctgatgtctgccatctccggtagcgcggttgtcctgcgggacggaggcgcgcaggaccgcaacctggtgcgcgacatcgcccgtcacggcgtcactgtcgttccagtcgtgccgtccatggcgtcaatgctcatcaccctgcagcgtcgtgatcagttgccgaccatcgtcagactgttcacgaataccggggcgcgtctggcacccgagaccgcgaaccagttgctcgcaagcttccccggctcccgctatgcgtcgatgtatggcatgacggagtgcaagcgcatctccatccttccggtggaggagtacgagacgcatccggacagcgtgggaagagctctgcccagcactcacgtcgagatcgttgacgctcagggagttccggttccggcgggcgagcacggggagatcacggtgtccggcccgaccgtgatgaacggctactggcaggtgccgaacagtcccagtggacgattccgacccagcggccacggcctcactctgttcaccggtgatcgcggctggatggatgaggagggacgtctctacctcctcgggcgcgacgacgagatcgtcaagcatcacggcatccgaatcagcctgcaggagatcgagatagccgccgaagccgcgccgggcgtcgacgcagtcatcgctctcaagccggcctccgactcggcccccattgaaatcgcctactgcggcagcacgagtcccgagaacctggcccgccatctcgaaaccgtcctggaccgggcgcgacgaccccaattcatccaccaactccagcagatccccctgacccgtaacgggaaaccaaaccggtcagcagccgccgaggccatccgctcaagggcgtgacggcgaaggccaacacccacagacgaaaggaaaccaccatgacccaggccgagttcaaccagttcatcgagtccacctgctccgcgacgatcgtggatcccgaccgtcctttggtcgatcagggcatcgactccctcggaatgctcaccctcatggtcgctatcgaggacagcctcggcatcgaactggatcccgagtccctcgccgacggtaggggttccacgccctccggtcttctgtcccttgtcgagcagccgaaagcgacggtgtgacgacatgacgacgatggttccttgccgccgtgtggagatgccgcaactgttcgaccacatccccggaagcatctctctctcaggagggctgcccgatctgagcgtgctcccgagcaatcagatcgccgaactgacgtcccggatcatgcgtctcggctcaagaatcctcctgcaatactccaccccttcggtctcgtcctccttggtgccggccatcctggacctggcggaacgaacatgcatgtcaccggatccgcggaatctgatcccgaccgcgggttcccaactgggcctggccatggtgatcaatgcctttgacggcgatgagatcatctgtgactgcgccacctatcccggggcgctggccgccttcgcctctgccggcgtggaaacaacgggggtggccagtgacgaggaggggctcaacccagacgcgctcgctcacgccgtcgcagagggtcgggccaatggccgccgcatcgcagccgtctacaccacgcccaccttccagaatcccaccggctccgtacagtccgagaaccgccgtgcggccctgctcaaggtgtgtgctgacaatgacctcctcctcatcgaggacgatccgtacggcatgctgtccttcgacgggcagacgtggccagctctgaagtccatggacccacagcgcgtcatctacctgggcaccttctcgaaggtgttcgcaccgggcgtccgttccggctggatcgatccgcccgccaatcttgtcgagaaactccgcgctgtgtgcgagatcatgacactctcgccatcagccctcaaccaagcgatcatcggcgagtaccaccgtcgtcacggatgggacgaactgttggagggctatcgcgcctcctaccgcgaccgagcccgtctcctcatcggggctctcgaggctgaactggcaagaacgaattgcactggcacgtggacctggcgtgaaccacggggcggcttctacctgtggttggagaacgtcgccagcaccagcggtatcgacgttgcgcgtcgcgccgccgacaacggagtggccgtggtgcccgggaaacacttcgacgcagccggacacgattcgccgagcctgcgggtgtcgttcagcaattcacgcccggctgatctggtcgaaggagctcgtcgtctcgcccgtgcactggtgggagaggacgttcagaaatgactctcgcgacacgcaccgccaccgacaccctgcagcagaccttgccctggggcacccacgaacgtctcgtcttcgggcgggcgctcctgcgcagcaccggcttcccagccgaaggcttggccctgctcgactccgacgacatcctccccctcctcgactcctttcttgccggggacatcgacagaactcacttcgagaaggaatacaccagtcgcgaggagtccggcgcaagggcgctcatcaacgtcttgaaggacgatgcagtatcgcgcgccatcgcatggcagaaccccaccgcgtggaggtccttcgaatccctgtcgtccacgagcggaatcaatgcttcgactcggcgcaaggtacgccaactcgccctctactggcaacgttactgttccaaggctgagaccattggatacttcggcccgttcgcctgggccgaagtcgacccggaggcctctgcggtcgaattcatctcctccgaccatctgatcgaccgttcccacgtcgcaatggaggcgtgggcggtcattgagatcgggaaagccctggcatcacgggccgaccttcagtggtggatgccaccaatcctgtcccccgccgtcgacctcaacatggagagaggcaccgtgacggtggctggacaccagccacgacgggtccgggaggacgaggcacgagttctcttcctgaccgacggcacccgtcccgccgcccagatcgccaagagcctcgacatggagcccgagcggttgcgcaggatcctcgtggcccatgaacgtcgtcacaccgtgatctgggacgccaacatccctgtctcagtgcacgcgtgggacatcctgcacgaacgcattgcccagatcggagacgctgggctgcgagatgaggccactgctgttctcacgaggttcgacgagcttctggaggtcatccgcaacattcccgacgcccggtccctgacggaggcgacggaatccctgtcccgtcttttcgaaaccgtgacaggaacctcttcgaacagacgtgcgggccaggcatatgcagcccgcagcctgtgctacctggactgcacccgcgccggaaccgccaaggttgggacccggcttctcgaagccctcgacgcccccctcaacctcgtcctacaatccgctgactggttcgcggcgaccttggcaaaggaatacaccaccgaaatcacggacctcgcaaatcgaaagcagcgggcctcccaccagccactgaccatggctgatgtctggccgtccacgatgtcgctgttctggggggactcaccgtccccactgcagcgagccgtgaccgaactgtcacggcggtggagcagagtcctcgaggggctgcagccagtcgacggtcgcatcgacacgacatcgtccgctctctcgggcgccgtggacgagcagttccccgtgtgcaccccgattccagaactgtcagtgcacagcccggacctccaggtcatcacctcgagcactagcaacatcgcctccggacgagtcactgcagtcatgggtgagctacatgcctgtctgagcagtctcgacatgccgttgctcgagtggtcgctgccccatggttccattcgcgatcgcatcaacaccgcgctcaacctgcgacgtctggttcccttgttccccgagacatggaggcgcaacaccggccgcatggttccagcgacggtcggagtgggggatcgcgcaatcgggttcactcggacggccgatcaagaccgtgcgaacacatggtcgatgtcggcactgctgttcgagcagaccgaggacggactcatgatccgtgatcccgatggcaggctctggaccatcgcacaagcgtggagcgtgcccatctccatggtcgccgccgatgcgttcaagatcgggctgcccggctcaccagcccctcggctcaccattgacaatctcgtcgtgttccgtcgtacctggaggtttcccgctggctccatcgacatcatgcacggttcagccgccgagaaacacgctcggctgagggagtggcaggtcacgaatcaccttcctgaccacctcttcgtcaagttcccctccgaacccaagccgatctacttctccttcgagtcccccgccatggccacggtcttcacgcgatcactgcagcgcgacgcccgagagaatccagacagtctcgtgacgatgtccgaagcactgcccgagcctcaatcctcatggctgcacgacacccggagccaccactacgtccacgaattccggctgcaactgaccaaggagcgacatgacgaccacagttgagacacatcccgaaacacgtggcacaaccgcgacatccatctccaatctgatcggtcacacccctctcgtaagaatggaccatctgttcgacggcctccccttcgaggtgtacggcaagctcgagaagctcaatcctggcggaagcatcaaggatcgagcagcacaatccatgatcgaacgggcaattcgacggggtgagatcgtcccgggccgtacgaccgtcatcgagtccagttcgggaaatctcggcatcgccgtggcgatactgtgccaggagcacggcctgaatttcatctgcgtaaccgatgccaaggccacgccaacgaacattcgactcatcgaagcgttcggggccactgttgaggtgatcgaagaacctcatcccgagagtggcgaattcctccccatgaggctcaagagggtaagagaactgctgtcagagattccagatgcatggtggccgaatcagtacgggaaccccgacaatccggcggctcacgagcggactgtccgcgagatcatcgaggcaatcccgcgggttgacacgattgtctgcgcgaccggctcgtgcggaacccttcgcggctgccacgaagcattgcgaaagctgtccccacgcacccgactcgtcgccgtggacgccaagggcagcgccatcttcgacgaggcaggagcaccccatccccgctgtgtcccgggacacggtgcgtcagtgcgaccgccgctgtggcgcgcggggctcgccgaccaactggttctggtctccgacgcggactgcgtcgtgggatgccaggaggccctgcgcaccgaggctcttctcctcggcggatcctcgggagcaattctgacggccattcaccgagtgtctcccacgattcccgctggttccaccgtggtgacgatcctccccgacggcggcgagcgctacatcgacaccatctacagccgctcgtgggtcgactcacacatccccgggctgccctctctcgccgactggggggctcccaaccccgccaattcgtatgacctgaacagaagtgcctcatgaagctctacaccagagagaccgtcgaaactgcgcttgtcgggcgtcatggccaggttctcagtgccgtacagagtgcatacatgctgcattcgacgggagagacatcgctgccattctcaaccttcctccgcccggccgggtatccgaacgatcggatcatcgcacttcccgcccacatcggaggcgacttcgacatagccggtatcaagtggatctcatccttcccggaaaacctcgaccggggccagcaacgagcttcctccgtactcatcctcaatagtctggagacgggatacccgaccgccctgctggagtccagtcagatttcagcaacgcgaacggcagcatcagccgccctggccagcgccaccctccatggctccgaagaccatgtcagcacgattggcatcatcggctgcggaacaatcaatcttgcaacgatcgactacctcttccacgtgcacccccagatcaacgaggtcctctccttcgatctgaggcgggagcgggcccatgagttctcgcacctcgtcaaggcttcgcacccagaggcccgggtccgtgtcgccaaggagcccgacgagattctggccgcaagcaacaccatcgcgatcgccacgaccgactcgagtcattggttggaccttccgccgtggcacgggccggggcaccaagtcgtcctgcacacgtcgctgcgagacctgtcagtgccctcgatcctggcagcggccaacgtcgttgacgatcctgatcacgtctgccgtgaagcgacgtccttggatctggcaactcagcagaccggcaaccgggacttcatcacggggagaatcggagacctccttcttggcgcgccgctgtcctcaagtcctgactcccgtgtcattttctcacccttcgggctcggcatcctcgacctcgcagtcgcctccgtcgtcattgctgccgcctcctcttcagcagtcgagatcaatgggttcgaccccgggaaacacgccacaagcatgattgaggtgaatcgatgaccaccacacagatcaacgacaacacggccgttctgcgcgacgtattccccgccggctccgtcgcattcgtgagcggtgcctcacgcggaattggcgctgcctgcgcgacagcccttgcggccgcgggatgcaacctcgccatcacttatcgaaggaaggagaacgaggcggcacaaatcgccgaatccattgaagccatcgggcgccagtgcatcacaatgcagatggacgtaaccgatgagaaccaagtgaccagagccttccgcatcattcgccagcattacggacgcctggacgccgcggtcttgaactcgggaatcaccagtgacgggcatcttgcaacaatgagccgctccaagtggagctcggtgatcgacacgaatctgaccggaaccttcctctgcacgcgcgaggcgaccaaggccatgtactcgtccggtggctcgatcgtcatggtcgcgtccaccagtggagttgcagggcgaccgggccaggccaactacgcagccagcaagggcggaatcgttgccatgatgaagacgctggccccggaggttgcggcaaagaacgtccgggtgaatgcggtggcacccggcttcattcagaccgacatggtggcggccgttccaaaagcggcactcgcccaggcaatccaacacatccccatgggccgtcttggcctggcacaggaggttgcgtcagccgttaccttcctggcctccccgctcgccgcctacatcacagggaagaccctcactatcgatggcggaatgatcaacggctgaccccaggacccgcacacccccagtaccgagaaagaaacaacaatgaccgagatcacccacactgccaacagcatccgaacccgcgccgaggaacgttccaacaaagcttggcgcctgaaggaggagatcatctccaagctcggtctcgagaccaagccagaatatgtctcggacaaccaaccgctcttcggacgtggccttgagatggattcccttgacactctcgaagtcgtcgtcgccgtcaacaatgagttcggagtctcggtcaacgacgacgacgtacaggcgttcggctcgatcaatgccatggtcgatttcatcgaggtgaacgagaagtgagttctcttgcgctcgaggcgccacccaaggacgcccgtaagaaattcgcctacgacagcgatgccatcaagacgatgctcccacatcgttggccgatgctcatgattgatcgcgcctacgacgtcgtcccagggaaatcgggcaaaggcatcaagtcggtcagcgtcaatgagccgttcttcgccggtcactaccctgaccattccatcatgcccggcgtcatgatcgtcgagtcgatggctcaactcgtggccgtcatctacgtagccgaggccattcagaacaatcccggcatgacgtcgcacgacgcacgttcaagcgttggttatctcggcgcgatccgtcagatgaagttccgacgcctcgtcactccgggcgaccaactcaccctccacgcccagctcggcgagaaagtgggggctctgcgcgaggtttccgtgagagcactcaatggccgggatgtcgtcgcccagggggaactcgtcgtcaccgagcggtgacacccagccacacacgagaaggaagtcccatgatcgttcgcccctacaggccacgtgatgcggaagcgatcgtacatctctacaacagccattccgactcccccaatccagtgtcgggagggattgttgaggaggagttccagagggagctcgaagaacgtggttcgacagtgttcctagtggccgaggaggccggatccattgtcggcacattcgggatgttccgcacgaatggccgacacaccatggccgatgatgaagtcttcgccgacatgttctatgtcaccccgtcacatcgactctcgacagttccgggacagctaatcactgaagccatcagcgagtgcttcatccagggcatcaacgtgatccgcctcaccgtgaaccccgcgaacatctccgcgctcaaggtttacagaaaagtcggttgtgcctgtctcggggccaccgatgcaggcgaggacgggaacattgagctgtacaacttcatccctctggttcttagggcaaccatcaccaaactcgaccacgattgtattcgagccctggcggacatgacttcgttcgcctgcatcaccgagggacgtccacttgatctgtcccacgacttcatcgtggacgctggacggaagatcgtctcccacagcatccagatcgggcgttcaaccatccacgccatggtcgacacgggctcgaggaccattgtggaggccaccctcgacaaccgcgactgggatgctcctcgccagatcgtcgcccccaccccctgtcagaaccggcccgaggaacagcgaggcaaccctgtccggctggtgcacaagaagcttgaggtcaccttcaacgaaggagtcattgagatcagtacgactggccactggggcccggtcctcgcaatgtcctggccctcctccgtctcgcaccgcgctcacgggtggcgacagggccccgccaagtcgtatcgatgcgagcttctcgagaattgcctcgtcctggatgacgaaggaggagtgaaatgcaccatcagcctcaatgattgccaagtcgcgatccggatggatggtgccccaaaaacggaattgagaatgtaccagtggtgcagcctgcgccagggctatctgacggctgacaccggcatcacgagcttcaaccgggcatccagtgggctcggagtcgccgtccgggactcgtccgagattgtcgccgcgggccttcccgccatccccgacccacccatcacatggagtgagggtgacatcacggttcagctcgatccctgcggccgcgcctccctgatccactcgaccctggtggaccgaagaatccacttggacgagtctggctcggcaagtctcaccatgaccgtgtttggtgattcccagccccatcgtgccgacaccgtcgagctgcctcccctcgcggcaggcaccgacaggatcgtcctcaagccggctgccggaggcgtgaccacatggcgcttgggcgccaccaaggtgctcaagtcaccgtggccacacgcccgcgcgctcgggcccaatccgatctggcgagccggcctgtgggtcagtcacgagccggatcgccacgaccgtcgccaaggaatggggtggggtcccgatcatcgcagttggaccctgtcggaagacaccatgaccagtactgacgggacactctcctggcgcttcagcggctcccccgacaccggctggacggtcgacgtcacgacgagcaacacgcacggggagaccgtcgtctggctcaccccggactgcccggcgggcgagaggatccgcacgtctgatcatgccgtgacgaccatgcttgacatctcgaagccatggcagcgctggaccacccgatgcgcaattcctctcagacacgggaagtggttcctcatcgagcctgatcatgacctcactgattcccccgaaatcctcatgcgctctgttcacggggtcctgctcgtcggctgtgtcggacgagcccactccggatccgcttcctggcgctttgccatcacgtcagaactccccacctccaacccaagaagaaacgactacacctcagccgcctgaacccaaccagttggaacacccactacagaagaaatggagcaccaccatgtccatcactgagcagtacaagacccttcgcacctcggtcggcctccacacgcctaccggtcccctggtccgtatcaccggtgatgatcgtctcgagtttctcgacaccttcctgtcccgcgcctcggacttcgtggaccccgacaccactcgggagtgcctcgctctcaccgaggacggccttccgctgacgatcttcctccacatcgagcgcgaggaggagtcatggctccttccccgcaccgccatcgatgcggcgaccctcgccacgtacctcggcaacctcgagaccgatggtgacctgtcaatcgagattgctccagagggttggggagctgtcgctgtcgaggggccgctgtcgtggcagatcgccgaaaaccttctcgacttcgacgtggctggcctcgttcttcacgccgtcacggacgtcgtcgttcccggggcccccgagggatcgaaggcatggctcgcccgggtcggaaccactggagagtacggctacctgctcgtctccaacgttcccgacctcgcccgcacttatctcctcagccgcgccacggagctgggcggtcaggcagtcgacgccgatgctctcgcacgagtccaggccgaggccgggatgccctattacgcgatgggcgtgtgccacctcgatgtcgccgggggtgacctcgcctggctcgtggactggcagcgcatcggcgagttccaaggatccgagaatctgcccacacccgtccgagaccagcgccgactggccgccatcgccctgcccaccggcaaccgcccggaagctggtcagaccgtcgctgccggggatgaggagattggaatggtggtgtacgtcaccccgtccgccaatcccgatgaggaactcgcgttcgcacttctggatgctcctttctggactcccacccttccgttgaccgtcggtgcccacgacgggaccacggtcaccctgccccgcgtcgtggcagcctccagcctcaacaagctggggtgacagcgatgacgatcactgctgagaacgccaccacccgcagcgacattgcccggagcattgcggtgaccggcgtgggactggtcacggcacagggtgaccataccgacgagtgctggaccgaacttgtcgatggggtttgcggaatcaccatgaacgtcacgttcgatgactctggcaccacgattccgtgtgctggcgtggctcccattccgaactctgattcgatcgaccgctgttacctgctcggcgtccatgccatgcgtgaagctctcgagatgagtggcatcgacctggactccgtgggtcgtgatcgcatcggactcgtggtgggctcaagcctcggcgcgatgcccaccttggaggcggctcatcgccgggccattgagaccggcgtgctcgatgccggattggcggcagactcccagctccactgcgtcgccgaccacctcgccgctgagttcgacatccgtggaccccgcgtcgtgacatcgaatgcgtgtgccgctggtgccgtggcgatcggctacgccgcagaactcctctggtccgacgatgtggacctggtcgtctgtggcggtgtcgatccactggcccagatctctgccaatgggttcacgtgcctgggagctctcgacaatctcccatgcagcccgatggccggttcctccggtctgactctgggcgagggagccgggttcatggtcctcgagagaacagatgcggcggctgccagaggccaggaggtgatggccgaaatcgccggctacggcacaagttgtgatggttaccaccagactgccccggacccgggtggcaatggcgcccgcagctcaatggaggccgccctgcgctcagctcatctcaagccgtccgacgtcagctacgtcaatctccacggcaccggtactccgaccaacgacgccgtcgagccgaaggcactccggtcattgttcaagtccgatgaccttccccctgtcagttcggtgaagggcgccatcggtcacactctcggcgctgctggcgccatcgaggccgtgtgctcgatcaaggccatccacgagggggtcctgccgccaaccgtcaacaaccgcgggcaggcttcccgaactggtctcgacatcgtgccggagtgcgcacgcaaggccgctcccgacgtggtcatctccaactccttcgccttcgggggcaacaacgcatcagtggtcatcaccgcacctcgaggaggcgttcactgtaccgccccggcgcagcttcgcgaggtcggaatctcaggaatggcagctctggcgggaaaggccgccaactcggaggagcttctttcggccctgtcagaagattgtccaatctggatggccgatgagaagacctgggaaggggatgctgtccaaaccggccatgtggacatcaagcgcctgtcccgcacaatcaacccgtccaaggttcgtcggatggaccccttgggaatcatctccagcgcggtggtgactgatctgtatgcccgacacgggaagctgagccgcaaggatgccgaaagcacgggaatcatcttcgcaaccggctacggtcctgtgacggcggtgacgcagttcaatgacgggatcatccgccacggttccgagggtgccaacgccctggtgttcccgaacaccgtggtcaacgcagccgcaggccacctcgcgatgctgaatcgctaccgtggttacacggccaccttggcatgcggtggaaccagttcactcatggcgctgcttctcgctgctcgcgtcgttggccgcggcgctgcggatcgcatcatggtcgttatcgctgacgagtttcccagcattgccgtccaggccgtcgcgaagcttcctggctaccgacacagggttgatggttccggagccgtgctctcggaaggcgcggtatgcgtcctggtggaggccgtcgaagtcgccgaagcacgcggtaccgcccccatggcgctgctacgcggcttcggatcccgtggagagtccgtgggagtcggtcacaccgcatccgatggacgggcttgggccaaggccatggccgctgcactgggcccggccggcctgactgcctccgacgtgtcgaccgtcgtggcggcatcaagcggacatcctcgcgtcgaccgagccgagcaggcggccaggcggatcgtcggactgtccgcaaccgctacgaccttcccaaaggcgattgtcggagaaacacacggatcggctgccgggatcgggctgttcggtgccctgtgcggttcgaggtcagccgcgcaccagaacatccttgtcaacgccttttcccacggcggtggttatgcctcgatggtggtggagtcactgtgaccacgacgcttctgccacgggttgcccagccgggaccgggcgtcagccatgtcgacaccgaccgtcccatcgagtgcatcatcacccaccacccccacatgccgcgtgatcgcggaggccacgccacctccgtgtcaggcaggtacttgctgcgccaagccgcagaactcatgctcggcacggatcctgcgcattgccccgtcgtcgacccttcgcggcgctggtactggcccggaatcaatcttcacggttctgtctcccatgtcccgggctggagcctgacgacgctgagcaccggcggccacatcggggcagacatccaggacttccgggagcgtcccggcgcaatggcattcatcggtgacctggtcaagctgtcgcgatcggcgtcactccgagaattcgcggagtgcgaggccgtcgtcaaggtgtccgaattgactaaggagacgttcgggcacgtgcgactgcccgaatggacacccggatggcgccacgttttcgaggactactgggtctggagtctcgagatgcacgggatgggagtcatcgcactcgcatccgatctcccccgagccattcgctggtggcggtgcgacgccgatgcccgtggccgtctccaggctctccgacccataagcagtcttggaccaggaaggccgtcatgagccggtactcacgtcgaatctcaggcatcgaacgcggctatctcaacgccgcaacccggggcccgcaccccaccatccacacgatgatcgacttcgagggccgcgtccccgccgactgttggcggcacgcatccacgattgcgtcggccgccaaccctggcatgacagtggtccggaggtcgggccgatggacatccgatccagcgggctgtccggttgtgttccacgactggaccgcggaccccaacgacgttgccgacttccacgctgacatggatctcgtgacgggaccatcgtccacgctccacgttttcgagggggcggaacgcacccgaatcaccttggcagcaagccatgccgtgaccgatgggcggggcatcgaacgatttctcgtcgacctgcttgcagcgttggacgagcgtgaacccattggaagccccgacaccctgaccgatgtcgatatcaaacgatccttggagaacagcatcaagccccgacgccacctggccgctgtgcccgccgatgtcctttctccactgggggggaggaagaaccaacgtatatgggcctccaggacgtggcacagtgccccgggagccatgagcggaagaatcgctgccgctgtggccgagatgatcgaccacgccgcaatgatcatcatcccggttgacatccggcggcacgtcccagaggtccgatccacagcaaacctaagtgcccaactgccagtgatcatcaccccgaaccagcgctggcaaagcatccatgggcatctgctcacggaccttgctcgccatcgagaccttgcgatcatcagtgaggatttccgccacaacaatccgttcgcatcgaccttggaggaaagccaggccatcggcctcgatggtgtctatccctgtgccgcaatcatctccgaccacgggaagctcgacctttcaaggttccagaccttggaactcaccccggtctcgatgcgaagcctcccgatgctcgttccctactccgcaatgttcatcagcagttgcaccgtcggcgagaccaccactgtcaccatcgctcatcgcgctgatgacgatcccgattccataaacaccttcttccaccacatcgaatcccagatgtccatctgagccacgtcgtccctggagagcaaacatgaccacccaaaatgtcaccaccccgccgcgccccgtcacctcccatgccacggcgaccaggtccgaggctccaccgcgaagcgtcatcagagccatggccatctcgatggtcgcgaccctcatggtcatgctcgacacgaccgtcgtgaacgtgtccttgagcgcgaccaccgcccgcttcgggagcatgggcagcgtgcagtgggtcctcacaagttacctacttgcactgtgcgcgacgatgacggcctccgcctgggtcatcgaccgccttggtccacggctcaccttcatcgcctcaatgaccatgttcctcatcggctcggtgatgtgtgcactgagcgattcagtgtggcaactcgtcactggcaggaccatctccggtgccggagctgggatccttgttccgacagcatccgtcctgcttatccgtggcatcccacgcgaacaacttggcagggtgcaggcactgaatgggagtgtccagttgatcgctcccctgatcggcccgactgtgggcggtctcctcgttgacaggtgcgggggctggccggccatctactgggcgaacgtccccgtagctcttgttcttctgattgaggccgtccgcgtcgatccggacgaaccacacaccgctaagcgccgcctcgatgctctcggcctggtctgtggcagcaccgcgatcgtgctgacagtgcttggtgtctcactcttcggcaggacgtcgcgaaacaccaccttcctgcttacgatcggcgcgcttgcagtcctcgcatgggcgttcttcatcacccacatccgaagggctaccaaccctctgcttgacgtttccctgtatcagaaccctgtctattcatggtccagcttcaacgtagcggtgcttggtttcggtctctacgcccccatggtcgtcatgcccctctatctcgaggcgacgcgccacctcactgccgtccacactggtctggtgatgtcagtggccggcgtcggcgtcattatggccggaatcctgtgcacgaagatcatgggccggatcggtggaggcctcacgatgacagttggcataactctgagcatcatcgccactctgcccctggtccggctgacgaaccacacctcctacatactcctggcagtctgcttggccttgcgtggagcaggaatcagcctgacaatcgtcccagccatgacacgggccttcgagtccatcaagaggacggccatggcggacgcctctgcacagctcaacctgttgcagcgaatcggcgggacaattgcgacagcagtcatcatcgcagttatccaccacgaggccatgctcacccgcggactctcccccacagtgttctcgcacgccaacgtgtggatcctcaccgcgaccgccgtcacccttctgccggccttcgcgcttgcgaaggccgaaagacaacagcaggatctctgagcaccgaggagtactccctcgtagaccctcctctgatctaattgggttcgttccaagtgtgtatctcactccggggagccccgattgctgaaccacatcccgttcaccctggcgagtccctcgtggtacgacgtcccctgggcgcccggatctccgtatctcacaggagatatctcggtcctgccagcggactcgccaaggtggacgacgaccatccggggtccttggcaaatccacatgccacctcgtccgacccttccagaggtggggtggaaagtgcatgtgtctgccaagccatcggaattggaatcggttgcctcagtcgtagcactgtggtgcgtacgccacagcgtccccttcaaagtacttcgcacccgaggtctcgttcacgcgagtcaagtcaagtatgcggaccgaagtcagagcggcaaggtctgcacctgctaccccgacggcgagagccttgagcacttctgctccggtcttgccgagctgcttcagaacgtcgattcacctccggtgtccggcgagctgcgagtcggatcctcccctctgtggttgcgtcacgggagtttccgagaggcatgggcggtgtcatccacaggagtaccgttcccggtctacccgggaacaacacatcctgatcgtcgaggccccgcgcccgcagaatccgatcacgacacgccgtggatccggaggctccgtcggacgaatcgccccagcacggttcttcccatcgacgatgtcagactcctccaccgatcaaatgctggcggcgtgtatcaggcaacatggagagacggcacatcggtagtcgtcaaggaggcccggcacctgtccggacttgatgcggcgggggtcgacgcccgagtgcggctgcgtcacgagtacgaggccctgagaagactggacccctatcgggccgctccccatcccattgatctcattgagaccgaggacggctcgttcctgatcatggaattccttgacggaatgacagtccaccaggagatgtcgaggttccatcctctgattagtaggcgacctcatcggctatcgatgaccgatttttcacgctggtgccgagaggtcgaagatcgcttgaggaatgtcacgagggtcatggccgggtgcggaatcgttcacggggatcttcatcccgcgaatctgatacatgtcggccatgaggttttggttactgactttgaatcctgctcaatcgacggggtcgccgtctcgtcagggatcgccgctccctggttccagtcggacgacacgattcccgatccggcgacgactgacgatctccacactcttctcgtggatccgacttgcggccccgcgcttgtcccccatccaaatcttcgcgcgctcatcagccaggccgcagtcgaggacatgatgggaaatccgactggtttaccacatgcctggaacctcgaggacatgacaagcgaactcgccaaggggatccgggcatcagccactcccgcacgagccgaccgcctctttccctcagacccctacctgttcgggcatccaggttcagaattcggcctgatgcatggcgccgccggaatcatggctgctcttgccgtgactgggtacggtgttgacgcgaatcacgtgacctggatgaaggaccgcttggccacccgcccgaccctgctgccggggttggccaacggaatcgagggaattgccctgggtctctccctgtgcggtcagaacgacatggctgcatccctgctccaccagtccggaattctcacgatcacaacgaacggatcgactgacctcaccctcggtactggtatggcgggccgagcgtgcgcgctgcagtccctctcacaacgactgtcatcgaaatctctcgcccacgctgcatataccctctgggaacaactcgccgtggctatgcggaacactgatgtggccttgccgaacggcctgttctccggttgggagggaatcgggctctccctgcttgcctctcccctgccggatcgtcatgatctcgcccgccactcactccgactggccctggccacgacaacgattgttgacggtgcgctcttctcaggcgagggacagatccgatggccatatctggggcgtggtcccgcggcatgtggcccgctcgccgccaggcttgatgatgaccagacggccaaggccgtggcacagacctgtcgttgtcccctgactgagtcatccggtctccacaatggccgcgcaggtctcctactcgtcctccgccagctcgtgggagaccaagacgacgccgttcgccgccacctcatgagactgtcgtggtcgatggaccgtcgcgaggaaggcacattgctgctgggtgatcatggcctgcgtttctcatccgatctcgcgacggggtcagccggcgccctcctcgccctgagcagggacccatggcggaacatgacacgaatgctcggaatatgcgatgacacctgtcatggcccactagtgacagtttgatctagcgccgatagttcacaactgaaagactccaaacatcgaggaaaacatgctgagccaaaacgccttggcaggcgtggctcgtttcaccacgatgaacaccaggagacagaatgtccgttgaggccatgcaatccatcgagatggacgaggaaaacagcgccagccagacagtttgcgcttgttacagcttcttctcgtggtcaggatgctgcgtagtctcccaagcggtggaagcatcttgatcgtgtgagacaccgtcgactaccctgtcccccgtggtacgcacacgccccgtcctggacagtcccggaagaccgctcatcgcctccggagtcgtcctggcggtcctgctcatcatcgcggtgatgacgatggtgcttcagcgcgaccccactctcacccccggacgccgcattctcggtatcgtcctgtccacggtccaggccgtcggattcatgtggctgcagacccgcatggttcgtcacggcaagggttcgcgcaacatgcgtgcgacccttggaagggtcggtttctgggccacgtggggactcgtcgcagtgggagtcgtcaatctgtggctgaccaactcgtggaccctcttcggggcctccgtcgccacgcccctccttctcctgccaggggtgtggagtgtggtggccaccctcgtgaccctgatcgtcggtttctccgacctcgtggtcacccacacctcgccactgacctcagccacggtcgtgctggtgaccatcgcggtgtcggtgaacctctacgcattcacgaagctgtcgacggcactcgttgaactccgctcctcccaggaggagatcgcccggctgcgcgtggacgccgagcgtcaccggatatcgcgggacctccacgacatcatcggtcgcaccctggtcgccacgtcgatgcgccagcaggcggccctccacctcgtcgaccgcgacccgcaacgggccaaggaacagctcgacgccgcccatgacgcaatcaccgaggggcagcaccagttgcgttccatcatccaggccgagatgagcaccagcctccccgacgagatcagcgacgccacattcctgtgcgaccgactccacatcgacttccgcatggatgaccgcggcagaccgcacaaacccttcgactcggcggcggcggcggccctgcgcgagggaatcacgaacatgctcaagcacagcgcggcgggctactgccacgtcgccatctccccggacctcctgaccgtcaccaacgacggttgtccgcaatcacctcgcccctccaccacaccgggcaccggaatcgaccatctccggtcccagatcgaggcgctcggtgggtcggtgacgacgtcgcggccctcgcggggcaccttccggctccgctgctccttcccgacccggggggcgtccacgaccacacccgcgaccgaaggaggacgatgacgacgagaatcctcctcgccgaggacatcaaactggtggcagaggccttcgaggcactgctctcggtggaaccggagttcgaggtcgtcgcacgggtggcacgcggcgacgacctggtcacatccgccacccgcctgttccccgacgtgatcctggccgacatcgacatgcccgggatgaccggcatcgaggccacccgaatgcttcgcgacaagggataccgcggcagaatcatcctgctcaccgccctgccgggaagcgggcacctgcacgccgcgatggctgccggagccgacgggtacctgctcaagtcgatcaccgcgccctccctcatcaacgccatccgggcggtgtgcaacggccagtcggccatcgacccgaacgtcgccgcggtcgccatgcgcaagggaccctcgcccctcaacgaccgggaaaccgagattctgcgcctagtcgccgacggttcctccaccgcgcagatcgcctcgcggctgtacctcagcaagggcaccgtcaggaactacctgtcgacggcgatgtcgaagctcgacgccgactcacgcacagcggcggtcacgcgggcacgcgaggagggctggctgtagcaggcgacccgctcagcccaccgcccctcagcccgccgactcctgacgcacggcctcctcgaccgcccggctgagcagggacccggccctgaccatcgacgtctccgggtccggctcgagatcggacaacgcgatgatccggtcgaacgcggaccgtttctcctcgggcaggtcacagcgtccgcacaccgcccagacgggcaccccggcgtcccgggcgatcttgcggatggtgtcgggaagcttgccgagcagggtctgctggtccagccgcccctcccccgtgacgacgagactggaggcggagatccgcgacaccgcgcgggaccatcccaggacgaccgccgcgcccgggcggtacctggtccccaggcacatcagcgcccagccgacccggctgggcggctgcgaaccccctggccaccgcccggcaggcctttcccgaactcagcgaccccttgaaggagtcgacggcaacgatgaccggcgcattcggatcaggacgcatgggatcagcatgtcacgtcgatacggagcagtcgcgccgcctacccctagactcgggggcatggtcaaccgagtctacctgtccctgagcgttctcgccctcgtgctgtgggtggtcgcctaccgtcacatgccgggctgggccgcgggcatcaccctggtgggcatcgtcgtgctgtcgctgtggtgcgagtggtcgcgggtgcgcaccctggccaggatcggcaagtcccgccagcagggcccccgctcctcccgaggacgcaacctgtcgtgagcaatacgattcccgcagccctccaccccggccctgacgaggcc

SEQ ID NO: 429 - DNA, 26620 bp, Propionibacterium acnes
ccttgtggacaccacgtcatccacatgacttgtgtcacatgattcccggaccatcatcaagcagatgctcacccaactgtaatgatttctgttctgaatctggacatgctctgacctgcattcaatgatcaattccgtgcgatattccacaacgcacggggaggtcgcagacaatgacaacagaaagcatccccacgcggctgctcgtgtggcacgagcagaccgatccgaccaagctcctcaggatcaccgacgcgatcaggaggggggatccccttccccccatcgaggccatggcgatcggccacagattcctcgtcctcgacggtgcgcaccgggcccaagcccaccagtactgccatcgatctgagatccgagcccgcctccacaacctccccctcagcgcggaaataccaggctggagccactccataccccgcgatgcagcagcgaaactggctcacctactcctccccgtggacgctctcggtcaggcggaaatcgtcctgcacggggtgcgccgtcaggtggggaccgcttcacaacgaccgcgcgacatctttctcgcctgccaccggatcgcgcgagttgcctacgcgcatggaatcagacctctcggcccggagttctccaacgctccgacgatcgacgccgccaccatgacctggcgcccgccgaacgtgggcacgttgtgggccatcgccagcagtctcggacccctgcccgcaactgtgacccggttcgccccgatcctccggcacgacgccatcggggattccgcgatgacacccgtcacctccgccgcgtgacgacccgcgccaattccgccccaccactggatgaggggcagccgcgtggacgatgctcctgttcaggcagggactccatacgagaccaataggaaaatcatgatcaaaaacacaagccctctgaccgtgaaaaatgtctcgaaaacattccgtggctccagcggagaagccatcaaggccgtgcaagacgtgtcattcaccgttgagcgtggtgaggttgtggcattcctcggcccgaacggcgccgggaagtccaccaccatcgacatggctctcggcctcacccgccccgacagcggccagatcgaggtcttcggtactgacccgctcagcgcggcccggtcgggacgctgcaccgcgatgacacagaccggcgggttgctgcccgacctcacgattgggcagaccatggagatcatctcctcgctctatcgtggctcccacatgaatgcctgcatggagcgagcaaggatcacgcatctggccgatcggcaggtgtcgatgtgctcgggaggcgagcgccaacgacttcgcttcgcactggctctgctgcccgatcctgacttcctcatcctcgacgagcccactgcggggatggatgtggaggcgcgccgggacttctgggcagagatccacgaggacacgcgtcgtggtcggacaattctgttcgcaacgcactacctcgacgaggtggacgagttcgccgatcgggtcatcctcatcaaggagggccgcgtcatcgccgacgacacctccgacgcgatccgcaccatgtcggggggttgcaccgttacggcgaccattcccgacttctccctggcacgactgaatctgccgggcacccaactcatcaagcagggcggcgcacgcgttgatctgcaccatcccgattccgatgccctcgcagcgcgagtcatccagctcggcggcaccgacctgcgcgtggtcccccgcagcctcgacgacgccttcctcgctctcacctcaaccaccaaggagtcctgacatgaccgcccaagcgcttcccgcagtcgccactcccaaggcccgccaccgatccgccatctcgctgaagtacttgtggtgcgagatgcgtcgccccttccggcgttcgacgatgctgttcaacctcgccctccccgcagttctgtacctggccctgttccgcaccgtccacaccgccgagctgccggacgggaacttcgcgatgtggatgatgatcggcatcgctgtctacggagcggccactgcgagcaccagctacgcagcctccatctccgtcgacgaggccaacgggtggacccgcaccatccgcctgacgccgttgtcgtcggtcgggtacgtgctggtgaaggtcctctgcgccatggccatcgccctggccccgaccctgctcatcggtctcatcgggctgttgaccggagctcacggcacgctgcgggtctgggtaatcggactgggggcggcttggctcagctcagcaatcttctccgccttcggcctggctctcggactgtccctgcgtcccgaggtcgtcatgcacgtccccggcctggtcatcaccggtctggcgttcctgggcaacgtcttcgtccccctcagcgggacgatgctcaccattggccgctggagccccgcctacggcatcaccgcgctggctcgttacccgctcaccaacggcatcgacatcgggggcggccacgactccctgacggctgccctcatcggcaccttctgctggttcgccggattcgtgttctgggcctcccgtcgatttaccaagagcacgggtcgtcagtgacagattcggccgatctccggaaggagcagtgttatgaccaagcccctcattgcagtggtcaccgcgggccaaggagcgcagaagcctcgcctgctcacgccatggctcaaggtccccggcgtcacggagaagcttgctgcatggtccgctcaggccgatgtggacctcgtcgagctcggtaccagggcgaatgcagaaaccttggcagcgaccgagaatgcgcagccactactggtctgtctcggagtcctcgtctcggatctcctggccgaccagaacattgtgctcgcaggacactccgtgggcgagctgacagcagcgtgtctcgccggggtagttgatcccgggacggccgtcactcttgcacgacggcgtggactggccatggcgcgggcctgcgctctccacccgaccaccatggcggccatcattggtgacaatccggatgacgtcctccggcggctctcggaactgggactcacggctgccaacatcaacggaggcggacagattgttgcggccggctccaccgacgcgatcgcggaactggtggcgacccctcccaacgggaccgcagtcaagccgttgcgagttgctggcgcctttcacaccaagtacatgacgcctgcgcaggacgctttcgcccaagctgctcaagacgtcaccttctccgacccgcagcacccgatcatctccaacctcgacgggcaggagatccggtccggcaatgacctgcgtgaacggctgattgcccaggtgaccgcgccagttcgatgggatctctgcatccagcagatcgcggatcgtcagccggaactcgccctatcggcccctccggggaaggtgcaggcgtcgctcttgtctcggcagatcccggacctcgcgacggtctgcatcaccacaccacgggaggcagcccaggctgcacagcggatcgaccagtccgtatccgtccttcagggggcatgatgctcatccccgagtacttcctcacagcctgttcggaccatgctgagcgcctggcgatcatcacccacaatgacgttgtgacgtgggccgaactggcgactcgcgtcgacggttttcggcgctggctgcgggaccatggcgtgcaccgccaggacagggtcgttctccagacgccaagcaccgtaggcacggtagccctcatgtgggcctgcctgctcgacggcgtgacgatggtcccggtgcaccaggacctcactgcctcccaggtgcagcaagtcatcgacgactgccgtccagctctggtgtgtggcagcccggacctcgtccaactcctcaactcccccggaatgaagacaagcacacctccaacgcggccggagtcaacgagtattctgccgtccttgtcccgggtcagccccgatgaccttgcgatgctcatctatacgtccggcacgacgggtctcccgaaggggatcatgtgtccccaccggcaggtcgccaccgccgcacggatcgtccatgactgtctcgggtaccgcacggacgacgtcattctctgtcgcctgccgttgtccttcgactacgggctctatcagattctgatgtctgccatctccggtagcgcggttgtcctgcgggacggaggcgcgcaggaccgcaacctggtgcgcgacatcgcccgtcacggcgtcactgtcgttccagtcgtgccgtccatggcgtcaatgctcatcaccctgcagcgtcgtgatcagttgccgaccatcgtcagactgttcacgaataccggggcgcgtctggcacccgagaccgcgaaccagttgctcgcaagcttccccggctcccgctatgcgtcgatgtatggcatgacggagtgcaagcgcatctccatccttccggtggaggagtacgagacgcatccggacagcgtgggaagagctctgcccagcactcacgtcgagatcgttgacgctcagggagttccggttccggcgggcgagcacggggagatcacggtgtccggcccgaccgtgatgaacggctactggcaggtgccgaacagtcccagtggacgattccgacccagcggccacggcctcactctgttcaccggtgatcgcggctggatggatgaggagggacgtctctacctcctcgggcgcgacgacgagatcgtcaagcatcacggcatccgaatcagcctgcaggagatcgagatagccgccgaagccgcgccgggcgtcgacgcagtcatcgctctcaagccggcctccgactcggcccccattgaaatcgcctactgcggcagcacgagtcccgagaacctggcccgccatctcgaaaccgtcctggaccgggcgcgacgaccccaattcatccaccaactccagcagatccccctgacccgtaacgggaaaccaaaccggtcagcagccgccgaggccatccgctcaagggcgtgacggcgaaggccaacacccacagacgaaaggaaaccaccatgacccaggccgagttcaaccagttcatcgagtccacctgctccgcgacgatcgtggatcccgaccgtcctttggtcgatcagggcatcgactccctcggaatgctcaccctcatggtcgctatcgaggacagcctcggcatcgaactggatcccgagtccctcgccgacggtaggggttccacgccctccggtcttctgtcccttgtcgagcagccgaaagcgacggtgtgacgacatgacgacgatggttccttgccgccgtgtggagatgccgcaactgttcgaccacatccccggaagcatctctctctcaggagggctgcccgatctgagcgtgctcccgagcaatcagatcgccgaactgacgtcccggatcatgcgtctcggctcaagaatcctcctgcaatactccaccccttcggtctcgtcctccttggtgccggccatcctggacctggcggaacgaacatgcatgtcaccggatccgcggaatctgatcccgaccgcgggttcccaactgggcctggccatggtgatcaatgcctttgacggcgatgagatcatctgtgactgcgccacctatcccggggcgctggccgccttcgcctctgccggcgtggaaacaacgggggtggccagtgacgaggaggggctcaacccagacgcgctcgctcacgccgtcgcagagggtcgggccaatggccgccgcatcgcagccgtctacaccacgcccaccttccagaatcccaccggctccgtacagtccgagaaccgccgtgcggccctgctcaaggtgtgtgctgacaatgacctcctcctcatcgaggacgatccgtacggcatgctgtccttcgacgggcagacgtggccagctctgaagtccatggacccacagcgcgtcatctacctgggcaccttctcgaaggtgttcgcaccgggcgtccgttccggctggatcgatccgcccgccaatcttgtcgagaaactccgcgctgtgtgcgagatcatgacactctcgccatcagccctcaaccaagcgatcatcggcgagtaccaccgtcgtcacggatgggacgaactgttggagggctatcgcgcctcctaccgcgaccgagcccgtctcctcatcggggctctcgaggctgaactggcaagaacgaattgcactggcacgtggacctggcgtgaaccacggggcggcttctacctgtggttggagaacgtcgccagcaccagcggtatcgacgttgcgcgtcgcgccgccgacaacggagtggccgtggtgcccgggaaacacttcgacgcagccggacacgattcgccgagcctgcgggtgtcgttcagcaattcacgcccggctgatctggtcgaaggagctcgtcgtctcgcccgtgcactggtgggagaggacgttcagaaatgactctcgcgacacgcaccgccaccgacaccctgcagcagaccttgccctggggcacccacgaacgtctcgtcttcgggcgggcgctcctgcgcagcaccggcttcccagccgaaggcttggccctgctcgactccgacgacatcctccccctcctcgactcctttcttgccggggacatcgacagaactcacttcgagaaggaatacaccagtcgcgaggagtccggcgcaagggcgctcatcaacgtcttgaaggacgatgcagtatcgcgcgccatcgcatggcagaaccccaccgcgtggaggtccttcgaatccctgtcgtccacgagcggaatcaatgcttcgactcggcgcaaggtacgccaactcgccctctactggcaacgttactgttccaaggctgagaccattggatacttcggcccgttcgcctgggccgaagtcgacccggaggcctctgcggtcgaattcatctcctccgaccatctgatcgaccgttcccacgtcgcaatggaggcgtgggcggtcattgagatcgggaaagccctggcatcacgggccgaccttcagtggtggatgccaccaatcctgtcccccgccgtcgacctcaacatggagagaggcaccgtgacggtggctggacaccagccacgacgggtccgggaggacgaggcacgagttctcttcctgaccgacggcacccgtcccgccgcccagatcgccaagagcctcgacatggagcccgagcggttgcgcaggatcctcgtggcccatgaacgtcgtcacaccgtgatctgggacgccaacatccctgtctcagtgcacgcgtgggacatcctgcacgaacgcattgcccagatcggagacgctgggctgcgagatgaggccactgctgttctcacgaggttcgacgagcttctggaggtcatccgcaacattcccgacgcccggtccccgacggaggcgacggaatccctgtcccgtcttttcgaaaccgtgacaggaacctcttcgaacagacgtgcgggccaggcatatgcagcccgcagcctgtgctacctggactgcacccgcgccggaaccgccaaggttgggacccggcttctcgaagccctcgacgcccccctcaacctcgtcctacaatccgctgactggttcgcggcgaccttggcaaaggaatacaccaccgaaatcacggacctcgcaaatcgaaagcagcgggcctcccaccagccactgaccatggctgatgtctggccgtccacgatgtcgctgttctggggggactcaccgcccccactgcagcgagccgtgaccgaactgtcacggcggtggagcagagtcctcgaggggctgcagccagtcgacggtcgcatcgacacgacatcgtccgctctctcgggcgccgtggacgagcagttccccgtgtgcaccccgattccagaactgtcagtgcacagcccggacctccaggtcatcacctcgagcactagcaacatcgcctccggacgagtcactgcagtcatgggtgagctacatgcctgtctgagcagtctcgacatgccgttgctcgagtggtcgctgccccatggttccattcgcgatcgcatcaacaccgcgctcaacctgcgacgtctggttcccttgttccccgagacatggaggcgcaacaccggccgcatggttccagcgacggtcggagtgggggatcgcgcaatcgggttcactcggacggccgatcaagaccgtgcgaacacatggtcgatgtcggcactgctgttcgagcagaccgaggacggactcatgatccgtgatcccgatggcaggctctggaccatcgcacaagcgtggagcgtgcccatctccatggtcgccgccgatgcgttcaagatcgggctgcccggctcaccagcccctcggctcaccattgacaatctcgtcgtgttccgtcgtacctggaggtttcccgctggctccatcgacatcatgcacggttcagccgccgagaaacacgctcggctgagggagtggcaggtcacgaatcaccttcctgaccacctcttcgtcaagttcccctccgaacccaagccgatctacttctccttcgagtcccccgccatggccacggtcttcacgcgatcactgcagcgcgacgcccgagagaatccagacagtctcgtgacgatgtccgaagcactgcccgagcctcaatcctcatggctgcacgacacccggagccaccactacgtccacgaattccggctgcaactgaccaaggagcgacatgacgaccacagttgagacacatcccgaaacacgtggcacaaccgcgacatccatctccaatctgatcggtcacacccctctcgtaagaatggaccatctgttcgacggcctccccttcgaggtgtacggcaagctcgagaagctcaatcctggcggaagcatcaaggatcgagcagcacaatccatgatcgaacgggcaattcgacggggtgagatcgtcccgggccgtacgaccgtcatcgagtccagttcgggaaatctcggcatcgccgtggcgatactgtgccaggagcacggcctgaatttcatctgcgtaaccgatgccaaggccacgccaacgaacattcgactcatcgaagcgttcggggccactgttgaggtgatcgaagaacctcatcccgagagtggcgaattcctccccatgaggctcaagagggtaagagaactgctgtcagagattccagatgcatggtggccgaatcagtacgggaaccccgacaatccggcggctcacgagcggactgtccgcgagatcatcgaggcaatcccgcgggttgacacgattgtctgcgcgaccggctcgtgcggaacccttcgcggctgccacgaagcattgcgaaagctgtccccacgcacccgactcgtcgccgtggacgccaagggcagcgccatcttcgacgaggcaggagcaccccatccccgctgtgtcccgggacacggtgcgtcagtgcgaccgccgctgtggcgcgcggggctcgccgaccaactggttctggtctccgacgcggactgcgtcgtgggatgccaggaggccctgcgcaccgaggctcttctcctcggcggatcctcgggagcaattctgacggccattcaccgagtgtctcccacgattcccgctggttccaccgtggtgacgatcctccccgacggcggcgagcgctacatcgacaccatctacagccgctcgtgggtcgactcacacatccccgggctgccctctctcgccgactggggggctcccaaccccgccaattcgtatgacctgaacagaagtgcctcatgaagctctacaccagagagaccgtcgaaactgcgcttgtcgggcgtcatggccaggttctcagtgccgtacagagtgcatacatgctgcattcgacgggagagacatcgctgccattctcaaccttcctccgcccggccgggtatccgaacgatcggatcatcgcacttcccgcccacatcggaggcgacttcgacatagccggtatcaagtggatctcatccttcccggaaaacctcgaccggggccagcaacgagcttcctccgtactcatcctcaatagtctggagacgggatacccgaccgccctgctggagtccagtcagatttcagcaacgcgaacggcagcatcagccgccctggccagcgccaccctccatggctccgaagaccatgtcagcacgattggcatcatcggctgcggaacaatcaatcttgcaacgatcgactacctcttccacgtgcacccccagatcaacgaggtcctctccttcgatctgaggcgggagcgggcccatgagttctcgcacctcgtcaaggcttcgcacccagaggcccgggtccgtgtcgccaaggagcccgacgagattctggccgcaagcaacaccatcgcgatcgccacgaccgactcgagtcattggttggaccttccgccgtggcacgggccggggcaccaagtcgtcctgcacacgtcgctgcgagacctgtcagtgccctcgatcctggcagcggccaacgtcgttgacgatcctgatcacgtctgccgtgaagcgacgtccttggatctggcaactcagcagaccggcaaccgggacttcatcacggggagaatcggagacctccttcttggcgcgccgctgtcctcaagtcctgactcccgtgtcattttctcacccttcgggctcggcatcctcgacctcgcagtcgcctccgtcgtcattgctgccgcctcctcttcagcagtcgagatcaatgggttcgaccccgggaaacacgccacaagcatgattgaggtgaatcgatgaccaccacacagatcaacgacaacacggccgttctgcgcgacgtattccccgccggctccgtcgcattcgtgagcggtgcctcacgcggaattggcgctgcctgcgcgacagcccttgcggccgcgggatgcaacctcgccatcacttatcgaaggaaggagaacgaggcggcacaaatcgccgaatccattgaagccatcgggcgccagtgcatcacaatgcagatggacgtaaccgatgagaaccaagtgaccagagccttccgcatcattcgccagcattacggacgcctggacgccgcggtcttgaactcgggaatcaccagtgacgggcatcttgcaacaatgagccgctccaagtggagctcggtgatcgacacgaatctgaccggaaccttcctctgcacgcgcgaggcgaccaaggccatgtactcgtccggtggctcgatcgtcatggtcgcgtccaccagtggagttgcagggcgaccgggccaggccaactacgcagccagcaagggcggaatcgttgccatgatgaagacgctggccccggaggttgcggcaaagaacgtccgggtgaatgcggtggcacccggcttcattcagaccgacatggtggcggccgttccaaaagcggcactcgcccaggcaatccaacacatccccatgggccgtcttggcctggcacaggaggttgcgtcagccgttaccttcctggcctccccgctcgccgcctacatcacagggaagaccctcactatcgatggcggaatgatcaacggctgaccccaggacccgcacacccccagtaccgagaaagaaacaacaatgaccgagatcacccacactgccaacagcatccgaacccgcgccgaggaacgttccaacaaagcttggcgcctgaaggaggagatcatctccaagctcggtctcgagaccaagccagaatatgtctcggacaaccaaccgctcttcggacgtggccttgagatggattcccttgacactctcgaagtcgtcgtcgccgtcaacaatgagttcggagtctcggtcaacgacgacgacgtacaggcgttcggctcgatcaatgccatggtcgatttcatcgaggtgaacgagaagtgagttctcttgcgctcgaggcgccacccaaggacgcccgtaagaaattcgcctacgacagcgatgccatcaagacgatgctcccacatcgttggccgatgctcatgattgatcgcgcctacgacgtcgtcccagggaaatcgggcaaaggcatcaagtcggtcagcgtcaatgagccgttcttcgccggtcactaccctgaccattccatcatgcccggcgtcatgatcgtcgagtcgatggctcaactcgtggccgtcatctacgtagccgaggccattcagaacaatcccggcatgacgtcgcacgacgcacgttcaagcgttggttatctcggcgcgatccgtcagatgaagttccgacgcctcgtcactccgggcgaccaactcaccctccacgcccagctcggcgagaaagtgggggctctgcgcgaggtttccgtgagagcactcaatggccgggatgtcgtcgcccagggggaactcgtcgtcaccgagcggtgacacccagccacacacgagaaggaagtcccatgatcgttcgcccctacaggccacgtgatgcggaagcgatcgtacatctctacaacagccattccgactcccccaatccagtgtcgggagggattgttgaggaggagttccagagggagctcgaagaacgtggttcgacagtgttcctagtggccgaggaggccggatccattgtcggcacattcgggatgttccgcacgaatggccgacacaccatggccgatgatgaagtcttcgccgacatgttctatgtcaccccgtcacatcgactctcgacagttccgggacagctaatcactgaagccatcagcgagtgcttcatccagggcatcaacgtgatccgcctcaccgtgaaccccgcgaacatctccgcgctcaaggtttacagaaaagtcggttgtgcctgtctcggggccaccgatgcaggcgaggacgggaacattgagctgtacaacttcatccctctggttcttagggcaaccatcaccaaactcgaccacgattgtattcgagccctggcggacatgacttcgttcgcctgcatcaccgagggacgtccacttgatctgtcccacgacttcatcgtggacgctggacggaagatcgtctcccacagcatccagatcgggcgttcaaccatccacgccatggtcgacacgggctcgaggaccattgtggaggccaccctcgacaaccgcgactgggatgctcctcgccagatcgtcgcccccaccccctgtcagaaccggcccgaggaacagcgaggcaaccctgtccggctggtgcacaagaagcttgaggtcaccttcaacgaaggagtcattgagatcagtacgactggccactggggcccggtcctcgcaatgtcctggccctcctccgtctcgcaccgcgctcacgggtggcgacagggccccgccaagtcgtatcgatgcgagcttctcgagaattgcctcgtcctggatgacgaaggaggagtgaaatgcaccatcagcctcaatgattgccaagtcgcgatccggatggatggtgccccaaaaacggaattgagaatgtaccagtggtgcagcctgcgccagggctatctgacggctgacaccggcatcacgagcttcaaccgggcatccagtgggctcggagtcgccgtccgggactcgtccgagattgtcgccgcgggccttcccgtcatccctgacacaccgatcacatggagtgagggtgacatcacggttcagctcgatccctgcggccgcgcctccctgatccactcgaccctggtggaccgaagaatccacttggacgagtctggctcggcaagtctcaccatgaccgtgtttggtgattcccagccccatcgtgccgacaccgtcgagctgcctcccctcgcggcaggcaccgacaggatcgtcctcaagccggctgccggaggcgtgaccacatggcgcttgggcgccaccaaggtgctcaagtcaccgtggccacacgcccgcgcgctcgggcccaatccgatctggcgagccggcctgtgggtcagtcacgagccggatcgccacgaccgtcgccaaggaatggggtggggtcccgatcatcgcagttggaccctgtcggaagacaccatgaccagtactgacgggacactctcctggcgcttcagcggctcccccgacaccggctggacggtcgacgtcacgacgagcaacacgcacggggagaccgtcgtctggctcaccccggactgcccggcgggcgagaggatccgcacgtctgatcatgccgtgacgaccatgcttgacatctcgaagccatggcagcgctggaccacccgatgcgcaattcctctcagacacgggaagtggttcctcatcgagcctgatcatgacctcactgattcccccgaaatcctcatgcgctctgttcacggggtcctgctcgtcggctgtgtcggacgagcccactccggatccgcttcctggcgctttgccatcacgtcagaactccccacctccaacccaagaagaaacgactacacctcagccgcctgaacccaaccagttggaacacccactacagaagaaatggagcaccaccatgtccatcactgagcagtacaagacccttcgcacctcggtcggcctccacacgcctaccggtcccctggtccgtatcaccggtgatgatcgtctcgagtttctcgacaccttcctgtcccgcgcctcggacttcgtggaccccgacaccactcgggagtgcctcgctctcaccgaggacggccttccgctgacgatcttcctccacatcgagcgcgaggaggagtcatggctccttccccgcaccgccatcgatgcggcgaccctcgccacgtacctcggcaacctcgagaccgatggtgacctgtcaatcgagattgctccagagggttggggagctgtcgctgtcgaggggccgctgtcgtggcagatcgccgaaaaccttctcgacttcgacgtggctggcctcgttcttcacgccgtcacggacgtcgtcgttcccggggcccccgagggatcgaaggcatggctcgcccgggtcggaaccactggagagtacggctacctgctcgtctccaacgttcccgacctcgcccgcacttatctcctcagccgcgccacggagctgggcggtcaggcagtcgacgccgatgctctcgcacgagtccaggccgaggccgggatgccctattacgcgatgggcgtgtgccacctcgatgtcgccgggggtgacctcgcctggctcgtggactggcagcgcatcggcgagttccaaggatccgagaatctgcccacacccgtccgagaccagcgccgactggccgccatcgccctgcccaccggcaaccgcccggaagctggtcagaccgtcgctgccggggatgaggagattggaatggtggtgtacgtcaccccgtccgccaatcccgatgaggaactcgcgttcgcacttctggatgctcctttctggactcccacccttccgttgaccgtcggtgcccacgacgggaccacggtcaccctgccccgcgtcgtggcagcctccagcctcaacaagctggggtgacagcgatgacgatcactgctgagaacgccaccacccgcagcgacattgcccggagcattgcggtgaccggcgtgggactggtcacggcacagggtgaccataccgacgagtgctggaccgaacttgtcgatggggtttgcggaatcaccatgaacgtcacgttcgatgactctggcaccacgattccgtgtgctggcgtggctcccattccgaactctgattcgatcgaccgctgttacctgctcggcgtccatgccatgcgtgaagctctcgagatgagtggcatcgacctggactccgtgggtcgtgatcgcatcggactcgtggtgggctcaagcctcggcgcgatgcccaccttggaggcggctcatcgccgggccattgagaccggcgtgctcgatgccggattggcggcagactcccagctccactgcgtcgccgaccacctcgccgctgagttcgacatccgtggaccccgcgtcgtgacatcgaatgcgtgtgccgctggtgccgtggcgatcggctacgccgcagaactcctctggtccgacgatgtggacctggtcgtctgtggcggtgtcgatccactggcccagatctctgccaatgggttcacgtgcctgggagctctcgacaatctcccatgcagcccgatggccggttcctccggtctgactctgggcgagggagccgggttcatggtcctcgagagaacagatgcggcggctgccagaggccaggaggtgatggccgaaatcgccggctacggcacaagttgtgatggttaccaccagactgccccggacccgggtggcaatggcgcccgcagctcaatggaggccgccctgcgctcagctcatctcaagccgtccgacgtcagctacgtcaatctccacggcaccggtactccgaccaacgacgccgtcgagccgaaggcactccggtcattgttcaagtccgatgaccttccccctgtcagttcggtgaagggcgccatcggtcacactctcggcgctgctggcgccatcgaggccgtgtgctcgatcaaggccatccacgagggggtcctgccgccaaccgtcaacaaccgcgggcaggcttcccgaactggtctcgacatcgtgccggagtgcgcacgcaaggccgctcccgacgtggtcatctccaactccttcgccttcgggggcaacaacgcatcagtggtcatcaccgcacctcgaggaggcgttcactgtaccgccccggcgcagcttcgcgaggtcggaatctcaggaatggcagctctggcgggaaaggccgccaactcggaggagcttctttcggccctgtcagaagattgtccaatctggatggccgatgagaagacctgggaaggggatgctgtccaaaccggccatgtggacatcaagcgcctgtcccgcacaatcaaaacgaaaaaggttcgtcggatggaccccttgggaatcatctccagcgcggtggtgactgatctgtatgcccgacacgggaagctgagccgcaaggatgccgaaagcacgggaatcatcttcgcaaccggctacggtcctgtgacggcggtgacgcagttcaatgacgggatcatccgccacggttccgagggtgccaacgccctggtgttcccgaacaccgtggtcaacgcagccgcaggccacctcgcgatgctgaatcgctaccgtggttacacggccaccttggcatgcggtggaaccagttcactcatggcgctgcttctcgctgctcgcgtcgttggccgcggcgctgcggatcgcatcatggtcgttatcgctgacgagtttcccagcattgccgtccaggccgtcgcgaagcttcctggctaccgacacagggttgatggttccggagccgtgctctcggaaggcgcggtatgcgtcctggtggaggccgtcgaagtcgccgaagcacgcggtaccgcccccatggcgctgctacgcggcttcggatcccgtggagagtccgtgggagtcggtcacaccgcatccgatggacgggcttgggccaaggccatggccgctgcactgggcccggccggcctgactgcctccgacgtgtcgaccgtcgtggcggcatcaagcggacatcctcgcgtcgaccgagccgagcaggcggccaggcggatcgtcggactgtccgcaaccgctacgaccttcccaaaggcgattgtcggagaaacacacggatcggctgccgggatcgggctgttcggtgccctgtgcggttcgaggtcagccgcgcaccagaacatccttgtcaacgccttttcccacggcggtggttatgcctcgatggtggtggagtcactgtgaccacgacgcttctgccacgggttgcccagccgggaccgggcgtcagccatgtcgacaccgaccgtcccatcgagtgcatcatcacccaccacccccacatgccgcgtgatcgcggaggccacgccacctccgtgtcaggcaggtacttgctgcgccaagccgcagaactcatgctcggcacggatcctgcgcattgccccgtcgtcgacccttcgcggcgctggtactggcccggaatcaatcttcacggttctgtctcccatgtcccgggctggagcctgacgacgctgagcaccggcggccacatcggggcagacatccaggacttccgggagcgtcccggcgcaatggcattcatcggtgacctggtcaagctgtcgcgatcggcgtcactccgagaattcgcggagtgcgaggccgtcgtcaaggtgtccgaattgactaaggagacgttcgggcacgtgcgactgcccgaatggacacccggatggcgccacgttttcgaggactactgggtctggagtctcgagatgcacgggatgggagtcatcgcactcgcatccgatctcccccgagccattcgctggtggcggtgcgacgccgatgcccgtggccgtctccaggctctccgacccataagcagtcttggaccaggaaggccgtcatgagccggtactcacgtcgaatctcaggcatcgaacgcggctatctcaacgccgcaacccggggcccgcaccccaccatccacacgatgatcgacttcgagggccgcgtccccgccgactgttggcggcacgcatccacgattgcgtcggccgccaaccctggcatgacagtggtccggaggtcgggccgatggacatccgatccagcgggctgtccggttgtgttccacgactggaccgcggaccccaacgacgttgccgacttccacgctgacatggatctcgtgacgggaccatcgtccacgctccacgttttcgagggggcggaacgcacccgaatcaccttggcagcaagccatgccgtgaccgatgggcggggcatcgaacgatttctcgtcgacctgcttgcagcgttggacgagcgtgaacccattggaagccccgacaccctgaccgatgtcgatatcaaacgatccttggagaacagcatcaagccccgacgccacctggccgctgtgcccgccgatgtcctttctccactgggggggaggaagaaccaacgtatatgggcctccaggacgtggcacagtgccccgggagccatgagcggaagaatcgctgccgctgtggccgagatgatcgaccacgccgcaatgatcatcatcccggttgacatccggcggcacgtcccagaggtccgatccacagcaaacctaagtgcccaactgccagtgatcatcaccccgaaccagcgctggcaaagcatccatgggcatctgctcacggaccttgctcgccatcgagaccttgcgatcatcagtgaggatttccgccacaacaatccgttcgcatcgaccttggaggaaagccaggccatcggcctcgatggtgtctatccctgtgccgcaatcatctccgaccacgggaagctcgacctttcaaggttccagaccttggaactcaccccggtctcgatgcgaagcctcccgatgctcgttccctactccgcaatgttcatcagcagttgcaccgtcggcgagaccaccactgtcaccatcgctcatcgcgctgatgacgatcccgattccataaacaccttcttccaccacatcgaatcccagatgtccatctgagccacgtcgtccctggagagcaaacatgaccacccaaaatgtcatcaccccgccgcgccccgtcacctcccatgccacggcgaccaggtccgaggctccaccgcgaagcgtcatcagagccatggccatctcgatggtcgcgaccctcatggtcatgctcgacacgaccgtcgtgaacgtgtccttgagcgcgaccaccgcccgcttcgggagcatgggcagcgtgcagtgggtcctcacaagttacctacttgcactgtgcgcgacgatgacggcctccgcctgggtcatcgaccgccttggtccacggctcaccttcatcgcctcaatgaccatgttcctcatcggctcggtgatgtgtgcactgagcgattcagtgtggcaactcgtcactggcaggaccatctccggtgccggagctgggatccttgttccgacagcatccgtcctgcttatccgtggcatcccacgcgaacaacttggcagggtgcaggcactgaatgggagtgtccagttgatcgctcccctgatcggcccgactgtgggcggtctcctcgttgacaggtgcgggggctggccggccatctactgggcgaacgtccccgtagctcttgttcttctgattgaggccgtccgcgtcgatccggacgaaccacacaccgctaagcgccgcctcgatgctctcggcctggtctgtggcagcaccgcgatcgtgctgacagtgcttggtgtctcactcttcggcaggacgtcgcgaaacaccaccttcctgcttacgatcggcgcgcttgcagtcctcgcatgggcgttcttcatcacccacatccgaagggctaccaaccctctgcttgacgtttccctgtatcagaaccctgtctattcatggtccagcttcaacgtagcggtgcttggtttcggtctctacgcccccatggtcgtcatgcccctctatctcgaggcgacgcgccacctcactgccgtccacactggtctggtgatgtcagtggccggcgtcggcgtcattatggccggaatcctgtgcacgaagatcatgggccggatcggtggaggcctcacgatgacagttggcataactctgagcatcatcgccactctgcccctggtccggctgacgaaccacacctcctacatactcctggcagtctgcttggccttgcgtggagcaggaatcagcctgacaatcgtcccagccatgacacgggccttcgagtccatcaagaggacggccatggcggacgcctctgcacagctcaacctgttgcagcgaatcggcgggacaattgcgacagcagtcatcatcgcagttatccaccacgaggccatgctcacccgcggactctcccccacagtgttctcgcacgccaacgtgtggatcctcaccgcgaccgccgtcacccttctgccggccttcgcgcttgcgaaggccgaaagacaacagcaggatctctgagcaccgaggagtactccctcgtagaccctcctctgatctaattgggttcgttccaagtgtgtatctcactccggggagccccgattgctgaaccacatcccgttcaccctggcgagtccctcgtggtacgacgtcccctgggcgcccggatctccgtatctcacaggagatatctcggtcctgccagcggactcgccaaggtggacgacgaccatccggggtccttggcaaatccacatgccacctcgtccgacccttccagaggtggggtggaaagtgcatgtgtctgccaagccatcggaattggaatcggttgcctcagtcgtagcactgtggtgcgtacgccacagcgtccccttcaaagtacttcgcacccgaggtctcgttcacgcgagtcaagtcaagtatgcggaccgaagtcagagcggcaaggtctgcacctgctaccccgacggcgagagccttgagcacttctgctccggtcttgccgagctgcttcagaacgtcgattcacctccggtgtccggcgagctgcgagtcggatcctcccctctgtggttgcgtcacgggagtttccgagaggcatgggcggtgtcatccacaggagtaccgttcccggtctacccgggaacaacacatcctgatcgtcgaggccccgcgcccgcagaatccgatcacgacacgccgtggatccggaggctccgtcggacgaatcgccccagcacggttcttcccatcgacgatgtcagactcctccaccgatcaaatgctggcggcgtgtatcaggcaacatggagagacggcacatcggtagtcgtcaaggaggcccggcacctgtccggacttgatgcggcgggtgtcgacgcccgagtgcggctgcgtcacgagtacgaggccctgagaagactggacccctatcgggccgctccccatcccattgatctcattgagaccgaggacggctcgttcctgatcatggaattccttgacggaatgacagtccaccaggagatgtcgaggttccatcctctgattagtaggcgacctcatcggctatcgatgaccgatttttcacgctggtgccgagaggtcgaagatcgcttgaggaatgtcacgagggtcatggccgggtgcggaatcgttcacggggatcttcatcccgcgaatctgatacatgtcggccatgaggttttggttactgactttgaatcctgctcaatcgacggggtcgccgtctcgtcagggatcgccgctccctggttccagtcggacgacacgattcccgatccggcgacgactgacgatctccacactcttctcgtggatccgacttgcggccccgcgcttgtcccccatccaaatcttcgcgcgctcatcagccaggccgcagtcgaggacatgatgggaaatccgactggtttaccacatgcctggaacctcgaggacatgacaagcgaactcgccaaggggatccgggcatcagccactcccgcacgagccgaccgcctctttccctcagacccctacctgttcgggcatccaggttcagaattcggcctgatgcatggcgccgccggaatcatggctgctcttgccgtgactgggtacggtgttgacgcgaatcacgtgacctggatgaaggaccgcttggccacccgcccgaccctgctgccggggttggccaacggaatcgagggaattgccctgggtctctccctgtgcggtcagaacgacatggctgcatccctgctccaccagtccggaattctcacgatcacaacgaacggatcgactgacctcaccctcggtactggtatggcgggccgagcgtgcgcgctgcagtccctctcacaacgactgtcatcgaaatctctcgcccacgctgcatataccctctgggaacaactcgccgtggctgtgcggaacactgatgtggccttgccgaacggcctgttctccggttgggagggaatcgggctctccctgcttgcctctcccctgccggatcgtcatgatctcgcccgccactcactccgactggccctggccacgacaacgattgttgacggtgcgctcttctcaggcgagggacagatccgatggccatatctggggcgtggtcccgcggcatgtggcccgctcgccgccaggcttgatgatgaccagacggccaaggccgtggcacagacctgtcgttgtcccctgactgagtcatccggtctccacaatggccgcgcaggtctcctactcgtcctccgccagctcgtgggagaccaagacgacgccgttcgccgccacctcatgagactgtcgtggtcgatggaccgtcgcgaggaaggcacattgctgctgggtgatcatggcctgcgtttctcatccgatctcgcgacggggtcagccggcgccctcctcgccctgagcagggacccatggcggaacatgacacgaatgctcggaatatgcgatgacacctgtcatggcccactagtgacagtttgatctagcgccgatagttcacaactgaaagactccaaacatcgaggaaaacatgctgagccaaaacgccttggcaggcgtggctcgtttcaccacgatgaacaccaggagacagaatgtccgttgaggccatgcaatccatcgagatggacgaggaaaacagcgccagccagacagtttgcgcttgttacagcttcttctcgtggtcaggatgctgcgtagtctcccaagcggtggaagcatcttgatcgtgtgagacaccgtcgactaccctgtcccccgtggtacgcacacgccccgtcctggacagtcccggaagaccgctcatcgcctccggagtcgtcctggcggtcctgctcatcatcgcggtgatgacgatggtgcttcagcgcgaccccactctcacccccggacgccgcattctcggtatcgtcctgtccacggtccaggccgtcggattcatgtggctgcagacccgcatggttcgtcacggcaagggttcgcgcaacatgcgtgcgacccttggaagggtcggtttctgggccacgtggggactcgtcgcagtgggagtcgtcaatctgtggctgaccaactcgtggaccctcttcggggcctccgtcgccacgcccctccttctcctgccaggggtgtggagtgtggtggccaccctcgtgaccctgatcgtcggtttctccgacctcgtggtcacccacacctcgccactgacctcagccacggtcgtgctggtgaccatcgcggtgtcggtgaacctctacgcattcacgaagctgtcgacggcactcgttgaactccgctcctcccaggaggagatcgcccggctgcgcgtggacgccgagcgtcaccggatatcgcgggacctccacgacatcatcggtcgcaccctggtcgccacgtcgatgcgccagcaggcggccctccacctcgtcgaccgcgacccgcaacgggccaaggaacagctcgacgccgcccatgacgcaatcaccgaggggcagcaccagttgcgttccatcatccaggccgagatgagcaccagcctccccgacgagatcagcgacgccacattcctgtgcgaccgactccacatcgacttccgcatggatgaccgcggcagaccgcacaaacccttcgactcggcggcggcggcggccctgcgcgagggaatcacgaacatgctcaagcacagcgcggcgggctactgccacgtcgccatctccccggacctcctgaccgtcaccaacgacggttgtccgcaatcacctcgcccctccaccacaccgggcaccggaatcgaccatctccggtcccagatcgaggcgctcggtgggtcggtgacgacgtcgcggccctcgcggggcaccttccggctccgctgctccttcccgacccggggggcgtccacgaccacacccgcgaccgaaggaggacgatgacgacgagaatcctcctcgccgaggacatcaaactggtggcagaggccttcgaggcactgctctcggtggaaccggagttcgaggtcgtcgcacgggtggcacgcggcgacgacctggtcacatccgccacccgcctgttccccgacgtgatcctggccgacatcgacatgcccgggatgaccggcatcgaggccacccgaatgcttcgcgacaagggataccgcggcagaatcatcctgctcaccgccctgccgggaagcgggcacctgcacgccgcgatggctgccggagccgacgggtacctgctcaagtcgatcaccgcgccctccctcatcaacgccatccgggcggtgtgcaacggccagtcggccatcgacccgaacgtcgccgcggtcgccatgcgcaagggaccctcgcccctcaacgaccgggaaaccgagattctgcgcctagtcgccgacggttcctccaccgcgcagatcgcctcgcggctgtacctcagcaagggcaccgtcaggaactacctgtcgacggcgatgtcgaagctcgacgccgactcacgcacagcggcggtcacgcgggcacgcgaggagggctggctgtagcaggcgacccgctcagcccaccgcccctcagcccgccgactcctgacgcacggcctcctcgaccgcccggctgagcagggacccggccctgaccatcgacgtctccgggtccggctcgagatcggacaacgcgatgatccggtcgaacgcggaccgtttctcctcgggcaggtcacagcgtccgcacaccgcccagacgggcaccccggcgtcccgggcgatcttgcggatggtgtcgggaagcttgccgagcagggtctgctggtccagccgcccctcccccgtgacgacgagactggaggcggagatccgcgacaccgcgcgggaccatcccaggacgaccgccgcgcccgggcggtacctggtccccaggcacatcagcgcccagccgacccggctgggcggctgcgaaccccctggccaccgcccggcaggcctttcccgaactcagcgaccccttgaaggagtcgacggcaacgatgaccggcgcattcggatcaggacgcatgggatcagcatgtcacgtcgatacggagcagtcgcgccgcctacccctagactcgggggcatggtcaaccgagtctacctgtccctgagcgttctcgccctcgtgctgtgggtggtcgcctaccgtcacatgccgggctgggccgcgggcatcaccctggtgggcatcgtcgtgctgtcgctgtggtgcgagtggtcgcgggtgcgcaccctggccaggatcggcaagtcccgccagcagggcccccgctcctcccgaggacgcaacctgtcgtgagcaatacgattcccgcagccctccaccccggccctgacgaggcc

SEQ ID NO: 430 - DNA, 26620 bp, Propionibacterium acnes
ccttgtggacaccacgtcatccacatgacttgtgtcacatgattcccggaccatcatcaagcagatgctcacccaactgtaatgatttctgttctgaatctggacatgctctgacctgcattcaatgatcaattccgtgcgatattccacaacgcacggagaggtcacagacaatgataacagaaagcatccccacgcggctgctcgtgtggcacgagcagaccgatccgaccaagctcctcaggatcaccgacgcgatcaggaggggggatccccttccccccatcgaggccatggcgatcggccacagattcctcgtcctcgacggtgcgcaccgggcccaagcccaccagtactgccatcgatctgagatccgagcccgcctccacaacctccccctcagcgcggaagtaccaggctggagccactccataccccgcgatgcagcagcgaaactggctcacctactcctccccgtggacgctctcggtcaggcggaaatcgtcctgcacggggtgcgccgtcaggtggggaccgcttcacaacgaccgcgcgacatctttctcgcctgccaccggatcgcgcgagttgcctacgcgcatggaatcagacctctcggcccggagctctccaacgctccgacgatcgacgccgccaccatgacctggcgcccgccgaacgtgggcacgttgtgggccatcgccagcagtctcggacccctgcccgcaactgtgacccggttcgccccgatcctccggcacgacgccatcggggattccgcgatgacacccgtcacctccgccgcgtgacgacccgcgccaattccgccccaccactggatgaggggcagccgcgtggacgatgctcctgttcaggcagggactccatacgagaccaataggaaaatcatgatcaaaaacacaagccctctgaccgtgaaaaatgtctcgaaaacattccgtggctccagcggagaagccatcaaggccgtgcaagacgtgtcattcaccgttgagcgtggtgaggttgtggcattcctcggcccgaacggcgccgggaagtccaccaccatcgacatggctctcggcctcacccgccccgacagcggccagatcgaggtcttcggtactgacccgctcagcgcggcccggtcgggacgctgcaccgcgatgacacagaccggcgggttgctgcccgacctcacgattgggcagaccatggagatcatctcctcgctctatcgtggctcccacatgaatgcctgcatggagcgagcaaggatcacgcatctggccgatcggcaggtgtcgatgtgctcgggaggcgagcgccaacgacttcgcttcgcactggctctgctgcccgatcctgacttcctcatcctcgacgagcccactgcggggatggatgtggaggcgcgccgggacttctgggcagagatccacgaggacacgcgtcgtggtcggacaattctgttcgcaacgcactacctcgacgaggtggacgagttcgccgatcgggtcatcctcatcaaggagggccgcgtcatcgccgacgacacctccgacgcgatccgcaccatgtcggggggttgcaccgttacggcgaccattcccgacttctccctggcacgactgaatctgccgggcacccaactcatcaagcagggcggcgcacgcgttgatctgcaccatcccgattccgatgccctcgcagcgcgagtcatccagctcggcggcaccgacctgcgcgtggtcccccgcagcctcgacgacgccttcctcgctctcacctcaaccaccaaggagtcctgacatgaccgcccaagcgcttcccgcagtcgccactcccaaggcccgccaccgatccgccatctcgctgaagtacttgtggtgcgagatgcgtcgccccttccggcgttcgacgatgctgttcaacctcgccctccccgcagttctgtacctggccctgttccgcaccgtccacaccgccgagctgccggacgggaacttcgcgatgtggatgatgatcggcatcgctgtctacggagcggccactgcgagcaccagctacgcagcctccatctccgtcgacgaggccaacgggtggacccgcaccatccgcctgacgccgttgtcgtcggtcgggtacgtgctggtgaaggtcctctgcgccatggccatcgccctggccccgaccctgctcatcggtctcatcgggctgttgaccggagctcacggcacgctgcgggtctgggtaatcggactgggggcggcttggctcagctcagcaatcttctccgccttcggcctggctctcggactgtccctgcgtcccgaggtcgtcatgcacgtccccggcctggtcatcaccggtctggcgttcctgggcaacgtcttcgtccccctcagcgggacgatgctcaccattggccgctggagccccgcctacggcatcaccgcgctggctcgttacccgctcaccaacggcatcgacatcgggggcggccacgactccctgacggctgccctcatcggcaccttctgctggttcgccggattcgtgttctgggcctcccgtcgatttaccaagagcacgggtcgtcagtgacagattcggccgatctccggaaggagcagtgttatgaccaagcccctcattgcagtggtcaccgcgggccaaggagcgcagaagcctcgcctgctcacgccatggctcaaggtccccggcgtcacggagaagcttgctgcatggtccgctcaggccgatgtggacctcgtcgagctcggtaccagggcgaatgcagaaaccttggcagcgaccgagaatgcgcagccactactggtctgtctcggagtcctcgtctcggatctcctggccgaccagaacattgtgctcgcaggacactccgtgggcgagctgacagcagcgtgtctcgccggggtagttgatcccgggacggccgtcactcttgcacgacggcgtggactggccatggcgcgggcctgcgctctccacccgaccaccatggcggccatcattggtgacaatccggatgacgtcctccggcggctctcggaactgggactcacggctgccaacatcaacggaggcggacagattgttgcggccggctccaccgacgcgatcgcggaactggtggcgacccctcccaacgggaccgcagtcaagccgttgcgagttgctggcgcctttcacaccaagtacatgacgcctgcgcaggacgctttcgcccaagctgctcaggacgtcaccttctccgacccgcagcacccgatcatctccaacctcgacgggcaggagatccggtccggcaatgacctgcgtgaacggctgattgcccaggtgaccgcgccagttcgatgggatctctgcatccagcagatcgcggatcgtcagccggaactcgccctatcggcccctccggggaaggtgcaggcgtcgctcttgtctcggcagatcccggacctcgcgacggtctgcatcaccacaccacgggaggcagcccaggctgcacagcggatcgaccagtccgtatccgtccttcagggggcatgatgctcatccccgagtacttcctcacagcctgttcggaccatgctgagcgcctggcgatcatcacccacaatgacgttgtgacgtgggccgaactggcgactcgcgtcgacggttttcggcgctggctgcgggaccatggcgtgcaccgccaggacagggtcgttctccagacgccaagcaccgtaggcacggtagccctcatgtgggcctgcctgctcgacggcgtgacgatggtcccggtgcaccaggacctcactgcctcccaggtgcagcaagtcatcgacgactgccgtccagctctggtgtgtggcagcccggacctcgtccaactcctcaactcccccggaatgaagacaagcacacctccaacgcggccggagtcaacgagtattctgccgtccttgtcccgggtcagccccgatgaccttgcgatgctcatctatacgtccggcacgacgggtctcccgaaggggatcatgtgtccccaccggcaggtcgccaccgccgcacggatcgtccatgactgtctcgggtaccgcacggacgacgtcattctctgtcgcctgccgttgtccttcgactacgggctctatcagattctgatgtctgccatctccggtagcgcggttgtcctgcgggacggaggcgcgcaggaccgcaacctggtgcgcgacatcgcccgtcacggcgtcactgtcgttccagtcgtgccgtccatggcgtcaatgctcatcaccctgcagcgtcgtgatcagttgccgaccatcgtcagactgttcacgaataccggggcgcgtctggcacccgagaccgcgaaccagttgctcgcaagcttccccggctcccgctatgcgtcgatgtatggcatgacggagtgcaagcgcatctccatccttccggtggaggagtacgagacgcatccggacagcgtgggaagagctctgcccagcactcacgtcgagatcgttgacgctcagggagttccggttccggcgggcgagcacggggagatcacggtgtccggcccgaccgtgatgaacggctactggcaggtgccgaacagtcccagtggacgattccgacccagcggccacggcctcactctgttcaccggtgatcgcggctggatggatgaggagggacgtctctacctcctcgggcgcgacgacgagatcgtcaagcatcacggcatccgaatcagcctgcaggagatcgagatagccgccgaagccgcgccgggcgtcgacgcagtcatcgctctcaagccggcctccgactcggcccccattgaaatcgcctactgcggcagcacgagtcccgagaacctggcccgccatctcgaaaccgtcctggaccgggcgcgacgaccccaattcatccaccaactccagcagatccccctgacccgtaacgggaaaccaaaccggtcagcagccgccgaggccatccgctcaagggcgtgacggcgaaggccaacacccacagacgaaaggaaaccaccatgacccaggccgagttcaaccagttcatcgagtccacctgctccgcgacgatcgtggatcccgaccgtcctttggtcgatcagggcatcgactccctcggaatgctcaccctcatggtcgctatcgaggacagcctcggcatcgaactggatcccgagtccctcgccgacggtaggggttccacgccctccggtcttctgtcccttgtcgagcagccgaaagcgacggtgtgacgacatgacgacgatggttccttgccgccgtgtggagatgccgcaactgttcgaccacatccccggaagcatctctctctcaggagggctgcccgatctgagcgtgctcccgagcaatcagatcgccgaactgacgtcccggatcatgcgtctcggctcaagaatcctcctgcaatactccaccccttcggtctcgtcctccttggtgccggccatcctggacctggcggaacgaacatgcatgtcaccggatccgcggaatctgatcccgaccgcgggttcccaactgggcctggccatggtgatcaatgcctttgacggcgatgagatcatctgtgactgcgccacctatcccggggcgctggccgccttcgcctctgccggcgtggaaacaacgggggtggccagtgacgaggaggggctcaacccagacgcgctcgctcacgccgtcgcagagggtcgggccaatggccgccgcatcgcagccgtctacaccacgcccaccttccagaatcccaccggctccgtacagtccgagaaccgccgtgcggccctgctcaaggtgtgtgctgacaatgacctcctcctcatcgaggacgatccgtacggcatgctgtccttcgacgggcagacgtggccagctctgaagtccatggacccacagcgcgtcatctacctgggcaccttctcgaaggtgttcgcaccgggcgtccgttccggctggatcgatccgcccgccaatcttgtcgagaaactccgcgctgtgtgcgagatcatgacactctcgccatcagccctcaaccaagcgatcatcggcgagtaccaccgtcgtcacggatgggacgaactgttggagggctatcgcgcctcctaccgcgaccgagcccgtctcctcatcggggctctcgaggctgaactggcaagaacgaattgcactggcacgtggacctggcgtgaaccacggggcggcttctacctgtggttggagaacgtcgccagcaccagcggtatcgacgttgcgcgtcgcgccgccgacaacggagtggccgtggtgcccgggaaacacttcgacgcagccggacacgattcgccgagcctgcgggtgtcgttcagcaattcacgcccggctgatctggtcgaaggagctcgtcgtctcgcccgtgcactggtgggagaggacgttcagaaatgactctcgcgacacgcaccgccaccgacaccctgcagcagaccttgccctggggcacccacgaacgtctcgtcttcgggcgggcgctcctgcgcagcaccggcttcccagccgaaggcttggccctgctcgactccgacgacatcctccccctcctcgactcctttcttgccggggacatcgacagaactcacttcgagaaggaatacaccagtcgcgaggagtccggcgcaagggcgctcatcaacgtcttgaaggacgatgcagtatcgcgcgccatcgcatggcagaaccccaccgcgtggaggtccttcgaatccctgtcgtccacgagcggaatcaatgcttcgactcggcgcaaggtacgccaactcgccctctactggcaacgttactgttccaaggctgagaccattggatacttcggcccgttcgcctgggccgaagtcgacccggaggcctctgcggtcgaattcatctcctccgaccatctgatcgaccgttcccacgtcgcaatggaggcgtgggcggtcattgagatcgggaaagccctggcatcacgggccgaccttcagtggtggatgccaccaatcctgtcccccgccgtcgacctcaacatggagagaggcaccgtgacggtggctggacaccagccacgacgggtccgggaggacgaggcacgagttctcttcctgaccgacggcacccgtcccgccgcccagatcgccaagagcctcgacatggagcccgagcggttgcgcaggatcctcgtggcccatgaacgtcgtcacaccgtgatctgggacgccaacatccctgtctcagtgcacgcgtgggacatcctgcacgaacgcattgcccagatcggagacgctgggctgcgagatgaggccactgctgttctcacgaggttcgacgagcttctggaggtcatccgcaacattcccgacgcccggtccctgacggaggcgacggaatccctgtcccgtcttttcgaaaccgtgacaggaacctcttcgaacagacgtgcgggccaggcatatgcagcccgcagcctgtgctacctggactgcacccgcgccggaaccgccaaggttgggacccggcttctcgaagccctcgacgcccccctcaacctcgtcctacaatccgctgactggttcgcggcgaccttggcaaaggaatacaccaccgaaatcacggacctcgcaaatcgaaagcagcgggcctcccaccagccactgaccatggctgatgtctggccgtccacgatgtcgctgttctggggggactcaccgtccccactgcagcgagccgtgaccgaactgtcacggcggtggagcagagtcctcgaggggctgcagccagtcgacggtcgcatcgacacgacatcgtccgctctctcgggcgccgtggacgagcagttccccgtgtgcaccccgattccagaactgtcagtgcacagcccggacctccaggtcatcacctcgagcactagcaacatcgcctccggacgaatcactgcagtcatgggtgagctacatgcctgtctgagcagtctcgacatgccgttgctcgagtggtcgctgccccatggttccattcgcgatcgcatcaacaccgcgctcaacctgcgacgtctggttcccttgttccccgagacatggaggcgcaacaccggccgcatggttccagcgacggtcggagtgggggatcgcgcaatcgggttcactcggacggccgatcaagaccgtgcgaacacatggtcgatgtcggcactgctgttcgagcagaccgaggacggactcatgatccgtgatcccgatggcaggctctggaccatcgcacaagcgtggagcgtgcccatctccatggtcgccgccgatgcgttcaagatcgggctgcccggctcaccagcccctcggctcaccattgacaatctcgtcgtgttccgtcgtacctggaggtttcccgctggctccatcgacatcatgcacggttcagccgccgagaaacacgctcggctgagggagtggcaggtcacgaatcaccttcctgaccacctcttcgtcaagttcccctccgaacccaagccgatctacttctccttcgagtcccccgccatggccacggtcttcacgcgatcactgcagcgcgacgcccgagagaatccagacagtctcgtgacgatgtccgaagcactgcccgagcctcaatcctcatggctgcacgacacccggagccaccactacgtccacgaattccggctgcaactgaccaaggagcgacatgacgaccacagttgagacacatcccgaaacacgtggcacaaccgcgacatccatctccaatctgatcggtcacacccctctcgtaagaatggaccatctgttcgacggcctccccttcgaggtgtacggcaagctcgagaagctcaatcctggcggaagcatcaaggatcgagcagcacaatccatgatcgaacgggcaattcgacggggtgagatcgtcccgggccgtacgaccgtcatcgagtccagttcgggaaatctcggcatcgccgtggcgatgctgtgccaggagcacggcctgaatttcatctgcgtaaccgatgccaaggccacgccaacgaacattcgactcatcgaagcgttcggggccactgttgaggtgatcgaagaacctcatcccgagagtggcgaattcctccccatgaggctcaagagggtaagagaactgctgtcagagattccagatgcatggtggccgaatcagtacgggaaccccgacaatccggcggctcacgagcggactgtccgcgagatcatcgaggcaatcccgcgggttgacacgattgtctgcgcgaccggctcgtgcggaacccttcgcggctgccacgaagcattgcgaaagctgtccccacgcacccgactcgtcgccgtggacgccaagggcagcgccatcttcgacgaggcaggagcaccccatccccgctgtgtcccgggacacggtgcgtcagtgcgaccgccgctgtggcgcgcggggctcgccgaccaactggttctggtctccgacgcggactgcgtcgtgggatgccaggaggccctgcgcaccgaggctcttctcctcggcggatcctcgggagcaattctgacggccattcaccgagtgtctcccacgattcccgctggttccaccgtggtgacgatcctccccgacggcggcgagcgctacatcgacaccatctacagccgctcgtgggtcgactcacacatccccgggctgccctctctcgccgactggggggctcccaaccccgccaattcgtatgacctgaacagaagtgcctcatgaagctctacaccagagagaccgtcgaaactgcgcttgtcgggcgtcatggccaggttctcagtgccgtacagagtgcatacatgctgcattcgacgggagagacatcgctgccattctcaaccttcctccgcccggccgggtatccgaacgatcggatcatcgcacttcccgcccacatcggaggcgacttcgacatagccggtatcaagtggatctcatccttcccggaaaacctcgaccggggccagcaacgagcttcctccgtactcatcctcaatagtctggagacgggatacccgaccgccctgctggagtccagtcagatttcagcaacgcgaacggcagcatcagccgccctggccagcgccaccctccatggctccgaagaccatgtcagcacgattggcatcatcggctgcggaacaatcaatcttgcaacgatcgactacctcttccacgtgcacccccagatcaacgaggtcctctccttcgatctgaggcgggagcgggcccatgagttctcgcacctcgtcaaggcttcgcacccagaggcccgggtccgtgtcgccaaggagcccgacgagattctggccgcaagcaacaccatcgcgatcgccacgaccgactcgagtcattggttggaccttccgccgtggcacgggccggggcaccaagtcgtcctgcacacgtcgctgcgagacctgtcagtgccctcgatcctggcagcggccaacgtcgttgacgatcctgatcacgtctgccgtgaagcgacgtccttggatctggcaactcagcagaccggcaaccgggacttcatcacggggagaatcggagacctccttcttggcgcgccgctgtcctcaagtcctgactcccgtgtcattttctcacccttcgggctcggcatcctcgacctcgcagtcgcctccgtcgtcattgctgccgcctcctcttcagcagtcgagatcaatgggttcgaccccgggaaacacgccacaagcatgattgaggtgaatcgatgaccaccacacagatcaacgacaacacggccgttctgcgcgacgtattccccgccggctccgtcgcattcgtgagcggtgcctcacgcggaattggcgctgcctgcgcgacagcccttgcggccgcgggatgcaacctcgccatcacttatcgaaggaaggagaacgaggcggcacaaatcgccgaatccattgaagccatcgggcgccagtgcatcacaatgcagatggacgtaaccgatgagaaccaagtgaccagagccttccgcatcattcgccagcattacggacgcctggacgccgcggtcttgaactcgggaatcaccagtgacgggcatcttgcaacaatgagccgctccaagtggagctcggtgatcgacacgaatctgaccggaaccttcctctgcacgcgcgaggcgaccaaggccatgtactcgtccggtggctcgatcgtcatggtcgcgtccaccagtggagttgcagggcgaccgggccaggccaactacgcagccagcaagggcggaatcgttgccatgatgaagacgctggccccggaggttgcggcaaagaacgtccgggtgaatgcggtggcacccggcttcattcagaccgacatggtggcggccgttccaaaagcggcactcgcccaggcaatccaacacatccccatgggccgtcttggcctggcacaggaggttgcgtcagccgttaccttcctggcctccccgctcgccgcctacatcacagggaagaccctcactatcgatggcggaatgatcaacggctgaccccaggacccgcacacccccagtaccgagaaaggaacaacaatgaccgagatcacccacactgccaacagcatccgaacccgcgccgaggaacgttccaacaaagcttggcgcctgaaggaggagatcatctccaagctcggtctcgagaccaagccagaatatgtctcggacaaccaaccgctcttcggacgtggccttgagatggattcccttgacactctcgaagtcgtcgtcgccgtcaacaatgagttcggagtctcggtcaacgacgacgacgtacaggcgttcggctcgatcaatgccatggtcgatttcatcgaggtgaactagaagtgagttctcttgcgctcgaggcgccacccaaggacgcccgtaagaaattcgcctacgacagcgatgccatcaagacgatgctcccacatcgttggccgatgctcatgattgatcgcgcctacgacgtcgtcccagggaaatcgggcaaaggcatcaagtcggtcagcgtcaatgagccgttcttcgccggtcactaccctgaccattccatcatgcccggcgtcatgatcgtcgagtcgatggctcaactcgtggccgtcatctacgtagccgaggccattcagaacaatcccggcatgacgtcgcacgacgcacgttcaagcgttggttatctcggcgcgatccgtcagatgaagttccgacgcctcgtcactccgggcgaccaactcaccctccacgcccagctcggcgagaaagtgggggctctgcgcgaggtttccgtgagagcactcaatggccgggatgtcgtcgcccagggggaactcgtcgtcaccgagcggtgacacccagccacacacgagaaggaagtcccatgatcgttcgcccctacaggccacgtgatgcggaagcgatcgtacatctctacaacagccattccgactcccccaatccagtgtcgggagggattgttgaggaggagttccagagggagctcgaagaacgtggttcgacagtgttcctagtggccgaggaggccggatccattgtcggcacattcgggatgttccgcacgaatggccgacacaccatggccgatgatgaagtcttcgccgacatgttctatgtcaccccgtcacatcgactctcgacagttccgggacagctaatcactgaagccatcagcgagtgcttcatccagggcatcaacgtgatccgcctcaccgtgaaccccgcgaacatctccgcgctcaaggtttacagaaaagtcggttgtgcctgtctcggggccaccgatgcaggcgaggacgggaacattgagctgtacaacttcatccctctggttcttagggcaaccatcaccaaactcgaccacgattgtattcgagccctggcggacatgacttcgttcgcctgcatcaccgagggacgtccacttgatctgtcccacgacttcatcgtggacgctggacggaagatcgtctcccacagcatccagatcgggcgttcaaccatccacgccatggtcgacacgggctcgaggaccattgtggaggccaccctcgacaaccgcgactgggatgctcctcgccagatcgtcgcccccaccccctgtcagaaccggcccgaggaacagcgaggcaaccctgtccggctggtgcacaagaagcttgaggtcaccttcaacgaaggagtcattgagatcagtacgactggccactggggcccggtcctcgcaatgtcctggccctcctccgtctcgcaccgcgctcacgggtggcgacagggccccgccaagtcgtatcgatgcgagcttctcgagaattgcctcgtcctggatgacgaaggaggagtgaaatgcaccatcagcctcaatgattgccaagtcgcgatccggatggatggtgccccaaaaacggaattgagaatgtaccagtggtgcagcctgcgccagggctatctgacggctgacaccggcatcacgagcttcaaccgggcatccagtgggctcggagtcgccgtccgggactcgtccgagattgtcgccgcgggccttcccgtcatccctgacacaccgatcacatggagtgagggtgacatcacggttcagctcgatccctgcggccgcgcctccctgatccactcgaccctggtggaccgaagaatccacttggacgagtctggctcggcaagtctcaccatgaccgtgtttggtgattcccagccccatcgtgccgacaccgtcgagctgcctcccctcgcggcaggcaccgacaggatcgtcctcaagccggctgccggaggcgtgaccacatggcgcttgggcgccaccaaggtgctcaagtcaccgtggccacacgcccgcgcgctcgggcccaatccgatctggcgagccggcctgtgggtcagtcacgagccggatcgccacgaccgtcgccaaggaatggggtggggtcccgatcatcgcagttggaccctgtcggaagacaccatgaccagtactgacgggacactctcctggcgcttcagcggctcccccgacaccggctggacggtcgacgtcacgacgagcaacacgcacggggagaccgtcgtctggctcaccccggactgcccggcgggcgagaggatccgcacgtctgatcatgccgtgacgaccatgcttgacatctcgaagccatggcagcgctggaccacccgatgcgcaattcctctcagacacgggaagtggttcctcatcgagcctgatcatgacctcactgattcccccgaaatcctcatgcgctctgttcacggggtcctgctcgtcggctgtgtcggacgagcccactccggatccgcttcctggcgctttgccatcacgtcagaactccccacctccaacccaagaagaaacgactacacctcagccgcctgaacccaaccagttggaacacccactacagaagaaatggagcaccaccatgtccatcactgagcagtacaagacccttcgcacctcggtcggcctccacacgcctaccggtcccctggtccgtatcaccggtgatgatcgtctcgagtttctcgacaccttcctgtcccgcgcctcggacttcgtggaccccgacaccactcgggagtgcctcgctctcaccgaggacggccttccgctgacgatcttcctccacatcgagcgcgaggaggagtcatggctccttccccgcaccgccatcgatgcggcgaccctcgccacgtacctcggcaacctcgagaccgatggtgacctgtcaatcgagattgctccagagggttggggagctgtcgctgtcgaggggccgctgtcgtggcagatcgccgaaaaccttctcgacttcgacgtggctggcctcgttcttcacgccgtcacggacgtcgtcgttcccggggcccccgagggatcgaaggcatggctcgcccgggtcggaaccactggagagtacggctacctgctcgtctccaacgttcccgacctcgcccgcacttatctcctcagccgcgccacggagctgggcggtcaggcagtcgacgccgatgctctcgcacgagtccaggccgaggccgggatgccctattacgcgatgggcgtgtgccacctcgatgtcgccgggggtgacctcgcctggctcgtggactggcagcgcatcggcgagttccaaggatccgagaatctgcccacacccgtccgagaccagcgccgactggccgccatcgccctgcccaccggcaaccgcccggaagctggtcagaccgtcgctgccggggatgaggagattggagtggtggtgtacgtcaccccgtccgccaatcccgatgaggaactcgcgttcgcacttctggatgctcctttctggactcccacccttccgttgaccgtcggtgcccacgacgggaccacggtcaccctgccccgcgtcgtggcagcctccagcctcaacaagctggggtgacagcgatgacgatcactgctgagaacgccaccacccgcagcgacattgcccggagcattgcggtgaccggcgtgggactggtcacggcacagggtgaccataccgacgagtgctggaccgaacttgtcgatggggtttgcggaatcaccatgaacgtcacgttcgatgactctggcaccacgattccgtgtgctggcgtggctcccattccgaactctgattcgatcgaccgctgttacctgctcggcgtccatgccatgcgtgaagctctcgagatgagtggcatcgacctggactccgtgggtcgtgatcgcatcggactcgtggtgggctcaagcctcggcgcgatgcccaccttggaggcggctcatcgccgggccattgagaccggcgtgctcgatgccggattggcggcagactcccagctccactgcgtcgccgaccacctcgccgctgagttcgacatccgtggaccccgcgtcgtgacatcgaatgcgtgtgccgctggtgccgtggcgatcggctacgccgcagaactcctctggtccgacgatgtggacctggtcgtctgtggcggtgtcgatccactggcccagatctctgccaatgggttcacgtgcctgggagctctcgacaatctcccatgcagcccgatggccggttcctccggtctgactctgggcgagggagccgggttcatggtcctcgagagaacagatgcggcggctgccagaggccaggaggtgatggccgaaatcgccggctacggcacaagttgtgatggttaccaccagactgccccggacccgggtggcaatggcgcccgcagctcaatggaggccgccctgcgctcagctcatctcaagccgtccgacgtcagctacgtcaatctccacggcaccggtactccgaccaacgacgccgtcgagccgaaggcactccggtcattgttcaagtccgatgaccttccccctgtcagttcggtgaagggcgccatcggtcacactctcggcgctgctggcgccatcgaggccgtgtgctcgatcaaggccatccacgagggggtcctgccgccaaccgtcaacaaccgcgggcaggcttcccgaactggtctcgacatcgtgccggagtgcgcacgcaaggccgctcccgacgtggtcatctccaactccttcgccttcgggggcaacaacgcatcagtggtcatcaccgcacctcgaggaggcgttcactgtaccgccccggcgcagcttcgcgaggtcggaatctcaggaatggcagctctggcgggaaaggccgccaactcggaggagcttctttcggccctgtcagaagattgtccaatctggatggccgatgagaagacctgggaaggggatgctgtccaaaccggccatgtggacatcaagcgcctgtcccgcacaatcaacccgtccaaggttcgtcggatggaccccttgggaatcatctccagcgcggtggtgactgatctgtatgcccgacacgggaagctgagccgcaaggatgccgaaagcacgggaatcatcttcgcaaccggctacggtcctgtgacggcggtgacgcagttcaatgacgggatcatccgccacggttccgagggtgccaacgccctggtgttcccgaacaccgtggtcaacgcagccgcaggccacctcgcgatgctgaatcgctaccgtggttacacggccaccttggcatgcggtggaaccagttcactcatggcgctgcttctcgctgctcgcgtcgttggccgcggcgctgcggatcgcatcatggtcgttatcgctgacgagtttcccagcattgccgtccaggccgtcgcgaagcttcctggctaccgacacagggttgatggttccggagccgtgctctcggaaggcgcggtatgcgtcctggtggaggccgtcgaagtcgccgaagcacgcggtaccgcccccatggcgctgctacgcggcttcggatcccgtggagagtccgtgggagtcggtcacaccgcatccgatggacgggcttgggccaaggccatggccgctgcactgggcccggccggcctgactgcctccgacgtgtcgaccgtcgtggcggcatcaagcggacatcctcgcgtcgaccgagccgagcaggcggccaggcggatcgtcggactgtccgcaaccgctacgaccttcccaaaggcgattgtcggagaaacacacggatcggctgccgggatcgggctgttcggtgccctgtgcggttcgaggtcagccgcgcaccagaacatccttgtcaacgccttttcccacggcggtggttatgcctcgatggtggtggagtcactgtgaccacgacgcttctgccacgggttgcccagccgggaccgggcgtcagccatgtcgacaccgaccgtcccatcgagtgcatcatcacccaccacccccacatgccgcgtgatcgcggaggccacgccacctccgtgtcaggcaggtacttgctgcgccaagccgcagaactcatgctcggcacggatcctgcgcattgccccgtcgtcgacccttcgcggcgctggtactggcccggaatcaatcttcacggttctgtctcccatgtcccgggctggagcctgacgacgctgagcaccggcggccacatcggggcagacatccaggacttccgggagcgtcccggcgcaatggcattcatcggtgacctggtcaagctgtcgcgatcggcgtcactccgagaattcgcggagtgcgaggccgtcgtcaaggtgtccgaattgactaaggagacgttcgggcacgtgcgactgcccgaatggacacccggatggcgccacgttttcgaggactactgggtctggagtctcgagatgcacgggatgggagtcatcgcactcgcatccgatctcccccgagccattcgctggtggcggtgcgacgccgatgcccgtggccgtctccaggctctccgacccataagcagtcttggaccaggaaggccgtcatgagccggtactcacgtcgaatctcaggcatcgaacgcggctatctcaacgccgcaacccggggcccgcaccccaccatccacacgatgatcgacttcgagggccgcgtccccgccgactgttggcggcacgcatccacgattgcgtcggccgccaaccctggcatgacggtggtccggaggtcgggccgatggacatccgatccagcgggctgtccggttgtgttccacgactggaccgcggaccccaacgacgttgccgacttccacgctgacatggatctcgtgacgggaccatcgtccacgctccacgttttcgagggggcggaacgcacccgaatcaccttggcagcaagccatgccgtgaccgatgggcggggcatcgaacgatttctcgtcgacctgcttgcagcgttggacgagcgtgaacccattggaagccccgacaccctgaccgatgtcgatatcaaacgatccttggagaacagcatcaagccccgacgccacctggccgctgtgcccgccgatgtcctttctccactgggggggaggaagaaccaacgtatatgggcctccaggacgtggcacagtgccccgggagccatgagcggaagaatcgctgccgctgtggccgagatgatcgaccacgccgcaatgatcatcatcccggttgacatccggcggcacgtcccagaggtccgatccacagcaaacctaagtgcccaactgccagtgatcatcaccccgaaccagcgctggcaaagcatccatgggcatctgctcacggaccttgctcgccatcgagaccttgcgatcatcagtgaggatttccgccacaacaatccgttcgcatcgaccttggaggaaagccaggccatcggcctcgatggtgtctatccctgtgccgcaatcatctccgaccacgggaagctcgacctttcaaggttccagaccttggaactcaccccggtctcgatgcgaagcctcccgatgctcgttccctactccgcaatgttcatcagcagttgcaccgtcggcgagaccaccactgtcaccatcgctcatcgcgctgatgacgatcccgattccataaacaccttcttccaccacatcgaatcccagatgtccatctgagccacgtcgtccctggagagcaaacatgaccacccaagatgtcatcaccccgccgcgccccgtcacctcccatgccacggcgaccaggtccgaggctccaccgcgaagcgtcatcagagccatggccatctcgatggtcgcgaccctcatggtcatgctcgacacgaccgtcgtgaacgtgtccttgagcgcgaccaccgcccgcttcgggagcatgggcagcgtgcagtgggtcctcacaagttacctacttgcactgtgcgcgacgatgacggcctccgcctgggtcatcgaccgccttggtccacggctcaccttcatcgcctcaatgaccatgttcctcatcggctcggtgatgtgtgcactgagcgattcagtgtggcaactcgtcactggcaggaccatctccggtgccggagctgggatccttgttccgacagcatccgtcctgcttatccgtggcatcccacgcgaacaacttggcagggtgcaggcactgaatgggagtgtccagttgatcgctcccctgatcggcccgactgtgggcggtctcctcgttgacaggtgcgggggctggccggccatctactgggcgaacgtccccgtagctcttgttcttctgattgaggccgtccgcgtcgatccggacgaaccacacaccgctaagcgccgcctcgatgctctcggcctggtctgtggcagcaccgcgatcgtgctgacagtgcttggtgtctcactcttcggcaggacgtcgcgaaacaccaccttcctgcttacgatcggcgcgcttgcagtcctcgcatgggcgttcttcatcacccacatccgaagggctaccaaccctctgcttgacgtttccctgtatcagaaccctgtctattcatggtccagcttcaacgtagcggtgcttggtttcggtctctacgcccccatggtcgtcatgcccctctatctcgaggcgacgcgccacctcactgccgtccacactggtctggtgatgtcagtggccggcgtcggcgtcattatggccggaatcctgtgcacgaagatcatgggccggatcggtggaggcctcacgatgacagttggcataactctgagcatcatcgccactctgcccctggtccggctgacgaaccacacctcctacatactcctggcagtctgcttggccttgcgtggagcaggaatcagcctgacaatcgtcccagccatgacacgggccttcgagtccatcaagaggacggccatggcggacgcctctgcacagctcaacctgttgcagcgaatcggcgggacaattgcgacagcagtcatcatcgcagttatccaccacgaggccatgctcacccgcggactctcccccacagtgttctcgcacgccaacgtgtggatcctcaccgcgaccgccgtcacccttctgccggccttcgcgcttgcgaaggccgaaagacaacagcaggatctctgagcaccgaggagtactccctcgtagaccctcctctgatctaattgggttcgttccaagtgtgtatctcactccggggagccccgattgctgaaccacatcccgttcaccctggcgagtccctcgtggtacgacgtcccctgggcgcccggatctccgtatctcacaggagatatctcggtcctgccagcggactcgccaaggtggacgacgaccatccggggtccttggcaaatccacatgccacctcgtccgacccttccagaggtggggtggaaagtgcatgtgtctgccaagccatcggaattggaatcggttgcctcagtcgtagcactgtggtgcgtacgccacagcgtccccttcaaagtacttcgcacccgaggtctcgttcacgcgagtcaagtcaagtatgcggaccgaagtcagagcggcaaggtctgcacctgctaccccgacggcgagagccttgagcacttctgctccggtcttgccgagctgcttcagaacgtcgattcacctccggtgtccggcgagctgcgagtcggatcctcccctctgtggttgcgtcacgggagtttccgagaggcatgggcggtgtcatccacaggagtaccgttcccggtctacccgggaacaacacatcctgatcgtcgaggccccgcgcccgcagaatccgatcacgacacgccgtggatccggaggctccgtcggacgaatcgccccagcacggttcttcccatcgacgatgtcagactcctccaccgatcaaatgctggcggcgtgtatcaggcaacatggagagacggcacatcggtagtcgtcaaggaggcccggcacctgtccggacttgatgcggcgggtgtcgacgcccgagtgcggctgcgtcacgagtacgaggccctgagaagactggacccctatcgggccgctccccatcccattgatctcattgagaccgaggacggctcgttcctgatcatggaattccttgacggaatgacagtccaccaggagatgtcgaggttccatcctctgattggtaggcgacctcatcggctatcgatgaccgatttttcacgctggtgccgataggtcgaagatcgcttgaggaatgtcacgagggtcatggccgggtgcggaatcgttcacggggatcttcatcccgcgaatctgatacatgtcggccatgaggttttggttactgactttgaatcctgctcaatcgacggggtcgccgtctcgtcagggatcgccgctccctggttccagtcggacgacacgattcccgatccggcgacgactgacgatctccacactcttctcgtggatccgacttgcggccccgcgcttgtcctccatccaaatcttcgcgcgctcatcagccaggccgcagtcgaggacatgatgggaaatccgactggtttaccacatgcctggaacctcgaggacatgacaagcgaactcgccaaggggatccgggcatcagccactcccgcacgagccgaccgcctctttccctcagacccctacctgttcgggcatccaggttcagaattcggcctgatgcatggcgccgccggaatcatggctgctcttgccgtgactgggtacggtgttgacgcgaatcacgtgacctggatgaaggaccgcttggccacccgcccgaccctgctgccggggttggccaacggaatcgagggaattgccctgggtctctccctgtgcggtcagaacgacatggctgcatccctgctccaccagtccggaattctcacgatcacaacgaacggatcgactgacctcaccctcggtactggtatggcgggccgagcgtgcgcgctgcagtccctctcacaacgactgtcatcgaaatctctcgcccacgctgcatataccctctgggaacaactcgccgtggctgtgcggaacactgatgtggccttgccgaacggcctgttctccggttgggagggaatcgggctctccctgcttgcctctcccctgccggatcgtcatgatctcgcccgccactcactccgactggccctggccacgacaacgattgttgacggtgcgctcttctcaggcgagggacagatccgatggccatatctggggcgtggtcccgcggcatgtggcccgctcgccgccaggcttgatgatgaccagacggccaaggccgtggcacagacctgtcgttgtcccctgactgagtcatccggtctccacaatggccgcgcaggtctcctactcgtcctccgccagctcgtgggagaccaagacgacgccgttcgccgccacctcatgagactgtcgtggtcgatggaccgtcgcgaggaaggcacattgctgctgggtgatcatggcctgcgtttctcatccgatctcgcgacgggatcagccggcgccctcctcgccctgagcagggacccatggcggaacatgacacgaatgctcggaatatgcgatgacacctgtcatggcccactagtgacagtttgatctagcgccgatagttcacaactgaaagactccaaacatcgaggaaaacatgctgagccaaaacgccttggcaggcgtggctcgtttcaccacgatgaacaccaggagacagaatgtccgttgaggccatgcaatccatcgagatggacgaggaaaacagcgccagccagacagtttgcgcttgttacagcttcttctcgtggtcaggatgctgcgtagtctcccaagcggtggaagcatcttgatcgtgtgagacgccgtcgactaccctgtcccccgtggtacgcacacgccccgtcctggacagtcccggaagaccgctcatcgcctccggagtcgtcctggcggtcctgctcatcatcgcggtgatgacgatggtgcttcagcgcgaccccactctcacccccggacgccgcattctcggtatcgtcctgtccacggtccaggccgtcggattcatgtggctgcagacccgcatggttcgtcacggcaagggttcgcgcaacatgcgtgcgacccttggaagggtcggtttctgggccacgtggggactcgtcgcagtgggagtcgtcaatctgtggctgaccaactcgtggaccctcttcggggcctccgtcgccacgcccctccttctcctgccaggggtgtggagtgtggtggccaccctcgtgaccctgatcgtcggtttctccgacctcgtggtcacccacacctcgccactgacctcagccacggtcgtgctggtgaccatcgcggtgtcggtgaacctctacgcattcacgaagctgtcgacggcactcgttgaactccgctcctcccaggaggagatcgcccggctgcgcgtggacgccgagcgtcaccggatatcgcgggacctccacgacatcatcggtcgcaccctggtcgccacgtcgatgcgccagcaggcggccctccacctcgtcgaccgcgacccgcaacgggccaaggaacagctcgacgccgcccatgacgcaatcaccgaggggcagcaccagttgcgttccatcatccaggccgagatgagcaccagcctccccgacgagatcagcgacgccacattcctgtgcgaccgactccacatcgacttccgcatggatgaccgcggcagaccgcacaaacccttcgactcggcggcggcggcggccctgcgcgagggaatcacgaacatgctcaagcacagcgcggcgggctactgccacgtcgccatctccccggacctcctgaccgtcaccaacgacggttgtccgcaatcacctcgcccctccaccacaccgggcaccggaatcgaccatctccggtcccagatcgaggcgctcggtgggtcggtgacgacgtcgcggccctcgcggggcaccttccggctccgctgctccttcccgacccggggggcgtccacgaccacacccgcgaccgaaggaggacgatgacgacgagaatcctcctcgccgaggacatcaaactggtggcagaggccttcgaggcactgctctcggtggaaccggagttcgaggtcgtcgcacgggtggcacgcggcgacgacctggtcacatccgccacccgcctgttccccgacgtgatcctggccgacatcgacatgcccgggatgaccggcatcgaggccacccgaatgcttcgcgacaagggataccgcggcagaatcatcctgctcaccgccctgccgggaagcgggcacctgcacgccgcgatggctgccggagccgacgggtacctgctcaagtcgatcaccgcgccctccctcatcaacgccatccgggcggtgtgcaacggccagtcggccatcgacccgaacgtcgccgcggtcgccatgcgcaagggaccctcgcccctcaacgaccgggaaaccgagattctgcgcctagtcgccgacggttcctccaccgcgcagatcgcctcgcggctgtacctcagcaagggcaccgtcaggaactacctgtcgacggcgatgtcgaagctcgacgccgactcacgcacagcggcggtcacgcgggcacgcgaggagggctggctgtagcaggcgacccgctcagcccaccgcccctcagcccgccgactcctgacgcacggcctcctcgaccgcccggctgagcagggacccggccctgaccatcgacgtctccgggtccggctcgaggtcggacaacgcgatgatccggtcgaacgcggaccgtttctcctcgggcaggtcacagcgtccgcacaccgcccagacgggcaccccggcgtcccgggcgatcttgcggatggtgtcgggaagcttgccgagcagggtctgctggtccagccgcccctcccccgtgacgacgagactggaggcggagatccgcgacaccgcgcgggaccatcccaggacgaccgccgcgcccgggcggtacctggtccccaggcacatcagcgcccagccgacccggctgggcggctgcgaaccccctggccaccgcccggcaggcctttcccgaactcagcgaccccttgaaggagtcgacggcaacgatgaccggcgcattcggatcaggacgcatgggatcagcatgtcacgtcgatacggagcagtcgcgccgcctacccctagactcgggggcatggtcaaccgagtctacctgtccctgagcgttctcgccctcgtgctgtgggtggtcgcctaccgtcacatgccgggctgggccgcgggcatcaccctggtgggcatcgtcgtgctgtcgctgtggtgcgagtggtcgcgggtgcgcaccctggccaggatcggcaagtcccgccagcagggcccccgctcctcccgaggacgcaacctgtcgtgagcaatacgattcccgcagccctccaccccggccctgacgaggcc

SEQ ID NO: 431 - DNA, 26620 bp, Propionibacterium acnes; identical to SEQ ID NO: 430

SEQ ID NO: 432 - DNA, 26636 bp, Propionibacterium acnes
ccttgtggacaccacgtcatccacatgacttgtgtcacatgattcccggaccatcatcaagcagatgctcacccaactgtaatgatttctgttctgaatctggacatgctctgacctgcattcaatgatcaattccgtgcgatattccacaacgcacggagaggtcgcagacaatgacaacagaaagcatccccacgcggctgctcgtgtggcacgagcagaccgatccgaccaagctcctcaggatcaccgacgcgatcaggaggggggatccccttccccccatcgaggccatggcgatcggccacaaattcctcgtcctcgacggtgcgcaccgggcccaagcccaccagtactgccatcgatctgagatccgagcccgcctccacaacctccccctcagcgcggaagtaccaggctggagccactccataccccgcgatgcagcagcgaaactggctcacctactcctccccgtggacgctctcggtcaggcggaacatcgtcctgcacggggtgcgccgtcaggtggggaccgcttcacaacgaccgcgcgacatctttctcgcctgccaccggatcgcgcgagttgcctacgcgcatggaatcagacctctcggcccggagttctccaacgctccgacgatcgacgccgccaccatgacctggcccccgccgaacgtgggcacgttgtgggccatcgccagcagtctcggacccctgcccgcaactgtgacccggttcgccccgatcctccggcacgacgccatcggggattccgcgatgacacccgtcacctccgccgcgtgacgacccgcgccaattccgccccaccactggatgaggggcagccgcgtggacgatgctcctgttcaggcagggactccatacgagaccaataggaaaatcatgatcaaaaacacaagccctctgaccgtgaaaaatgtctcgaaaacattccgtggctccagcggagaagccatcaaggccgtgcaagacgtgtcattcaccgttgagcgtggtgaggttgtggcattcctcggcccgaacggcgccgggaagtccaccaccatcgacatggctctcggcctcacccgccccgacagcggccagatcgaggtcttcggtactgacccgctcagcgcggcccggtcgggacgctgcaccgcgatgacacagaccggcgggttgctgcccgacctcacgattgggcagaccatggagatcatctcctcgctctatcgtggctcccacatgaatgcctgcatggagcgagcaaggatcacgcatctggccgatcggcaggtgtcgatgtgctcgggaggcgagcgccaacgacttcgcttcgcactggctctgctgcccgatcctgacttcctcatcctcgacgagcccactgcggggatggatgtggaggcgcgccgggacttctgggcagagatccacgaggacacgcgtcgtggtcggacaattctgttcgcaacgcactacctcgacgaggtggacgagttcgccgatcgggtcatcctcatcaaggagggccgcgtcatcgccgacgacacctccgacgcgatccgcaccatgtcggggggttgcaccgttacggcgaccattcccgacttctccctggcacgactgaatctgccgggcacccaactcatcaagcagggcggcgcacgcgttgatctgcaccatcccgattccgatgccctcgcagcgcgagtcatccagctcggcggcaccgacctgcgcgtggtcccccgcagcctcgacgacgccttcctcgctctcacctcaaccaccaaggagtcctgacatgaccgcccaagcgcttcccgcagtcgccactcccaaggcccgccaccgatccgccatctcgctgaagtacttgtggtgcgagatgcgtcgccccttccggcgttcgacgatgctgttcaacctcgccctccccgcagttctgtacctggccctgttccgcaccgtccacaccgccgagctgccggacgggaacttcgcgatgtggatgatgatcggcatcgctgtctacggagcggccactgcgagcaccagctacgcagcctccatctccgtcgacgaggccaacgggtggacccgcaccatccgcctgacgccgttgtcgtcggtcgggtacgtgctggtgaaggtcctctgcgccatggccatcgccctggccccgaccctgctcatcggtctcatcgggctgttgaccggagctcacggcacgctgcgggtctgggtaatcggactgggggcggcttggctcagctcagcaatcttctccgccttcggcctggctctcggactgtccctgcgtcccgaggtcgtcatgcacgtccccggcctggtcatcaccggtctggcgttcctgggcaacgtcttcgtccccctcagcgggacgatgctcaccattggccgctggagccccgcctacggcatcaccgcgctggctcgttacccgctcaccaacggcatcgacatcgggggcggccacgactccctgacggctgccctcatcggcaccttctgctggttcgccggattcgtgttctgggcctcccgtcgatttaccaagagcacgggtcgtcagtgacagattcggccgatctccggaaggagcagtgttatgaccaagcccctcattgcagtggtcaccgcgggccaaggagcgcagaagcctcgcctgctcacgccatggctcaaggtccccggcgtcacggagaagcttgctgcatggtccgctcaggccgatgtggacctcgtcgagctcggtaccagggcgaatgcagaaaccttggcagcgaccgagaatgcgcagccactactggtctgtctcggagtcctcgtctcggatctcctgaccgaccagaacattgtgctcgcaggacactccgtgggcgagctgacagcagcgtgtctcgccggggtagttgatcccgggacggccgtcactcttgcacgacggcgtggactggccatggcgcgggcctgcgctctccacccgaccaccatggcggccatcattggtgacaatccggatgacgtcctccggcggctctcggaactgggactcacggctgccaacatcaacggaggcggacagattgttgcggccggctccaccgacgcgatcgcggaactggtggcgacccctcccaacgggaccgcagtcaagccgttgcgagttgctggcgcctttcacaccaagtacatgacacctgcgcaggacgctttcgcccaagctgctcaggacgtcaccttctccgacccgcagcacccgatcatctccaacctcgacgggcaggagatccggtccggcaatgacctgcgtgaacggctgattgcccaggtgaccgcgccagttcgatgggatctctgcatccagcagatcgcggatcgtcagccggaactcgccctatcggcccctccggggaaggtgcaggcgtcgctcttgtctcggcagatcccggacctcgcgacggtctgcatcaccacaccacgggaggcagcccaggctgcacagcggatcgaccagtccgtatccgtccttcagggggcatgatgctcatccccgagtacttcctcacagcctgttcggaccatgctgagcgcctggcgatcatcacccacaatgacgttgtgacgtgggccgaactggcgactcgcgtcgacggttttcggcgctggctgcgggaccatggcgtgcaccgccaggacagggtcgttctccagacgccaagcaccgtaggcacggtagccctcatgtgggcctgcctgctcgacggcgtgacgatggtcccggtgcaccaggacctcactgcctcccaggtgcagcaagtcatcgacgactgccgtccagctctggtgtgtggcagcccggacctcgtccaactcctcaactcccccggaatgaagacaagcacacctccaacgcggccggagtcaacgagtattctgccgtccttgtcccgggtcagccccgatgaccttgcgatgctcatctatacgtccggcacgacgggtctcccgaaggggatcatgtgtccccaccggcaggtcgccaccgccgcacggatcgtccatgactgtctcgggtaccgcacggacgacgtcattctctgtcgcctgccgttgtccttcgactacgggctctatcagattctgatgtctgccatctccggtagcgcggttgtcctgcgggacggaggcgcgcaggaccgcaacctggtgcgcgacatcgcccgtcacggcgtcactgtcgttccagtcgtgccgtccatggcgtcaatgctcatcaccctgcagcgtcgtgatcagttgccgaccatcgtcagactgttcacgaataccggggcgcgtctggcacccgagaccgcgaaccagttgctcgcaagcttccccggctcccgctatgcgtcgatgtatggcatgacggagtgcaagcgcatctccatccttccggtggaggagtacgagacgcatccggacagcgtgggaagagctctgcccagcactcacgtcgagatcgttgacgctcagggagttccggttccggcgggcgagcacggggagatcacggtgtccggcccgaccgtgatgaacggctactggcaggtgccgaacagtcccagtggacgattccgacccagcggccacggcctcactctgttcaccggtgatcgcggctggatggatgaggagggacgtctctacctcctcgggcgcgacgacgagatcgtcaagcatcacggcatccgaatcagcctgcaggagatcgagatagccgccgaagccgcgccgggcgtcgacgcagtcatcgctctcaagccggcctccgactcggcccccattgaaatcgcctactgcggcagcacgagtcccgagaacctggcccgccatctcgaaaccgtcctggaccgggcgcgacgaccccaattcatccaccaactccagcagatccccctgacccgtaacgggaaaccaaaccggtcagcagccgccgaggccatccgctcaagggcgtgacggcgaaggccaacacccacagacgaaaggaaaccaccatgacccaggccgagttcaaccagttcatcgagtccacctgctccgcgacgatcgtggatcccgaccgtcctttggtcgatcagggcatcgactccctcggaatgctcaccctcatggtcgctatcgaggacagcctcggcatcgaactggatcccgagtccctcgccgacggtaggggttccacgccctccggtcttctgtcccttgtcgagcagctgaaagcgacggtgtgacgacatgacgacgatggttccttgccgccgtgtggagatgccgcaactgttcgaccacatccccggaagcatctctctctcaggagggctgcccgatctgagcgtgctcccgagcaatcagatcgccgaactgacgtcccggatcatgcgtctcggctcaagaatcctcctgcaatactccaccccttcggtctcgtcctccttggtgccggccatcctggacctggcggaacgaacatgcatgtcaccggatccgcggaatctgatcccgaccgcgggttcccaactgggcctggccatggtgatcaatgcctttgacggcgatgagatcatctgtgactgcgccacctatcccggggcgctggccgccttcgcctctgccggcgtggaaacaacgggggtggccagtgacgaggaggggctcaacccagacgcgctcgctcacgccgtcgcagagggtcgggccaatggccgccgcatcgcagccgtctacaccacgcccaccttccagaatcccaccggctccgtacagtccgagaaccgccgtgcggccctgctcaaggtgtgtgctgacaatgacctcctcctcatcgaggacgatccgtacggcatgctgtccttcgacgggcagacgtggccagctctgaagtccatggacccacagcgcgtcatctacctgggcaccttctcgaaggtgttcgcaccgggcgtccgttccggctggatcgatccgcccgccaatcttgtcgagaaactccgcgctgtgtgcgagatcatgacactctcgccatcagccctcaaccaagcgatcatcggcgagtaccaccgtcgtcacggatgggacgaactgttggagggctatcgcgcctcctaccgcgaccgagcccgtctcctcatcggggctctcgaggctgaactggcaagaacgaattgcactggcacgtggacctggcgtgaaccacggggcggcttctacctgtggttggagaacgtcgccagcaccagcggtatcgacgttgcgcgtcgcgccgccgacaacggagtggccgtggtgcccgggaaacacttcgacgcagccggacacgattcgccgagcctgcgggtgtcgttcagcaattcacgcccggctgatctggtcgaaggagctcgtcgtctcgcccgtgcactggtgggagaggacgttcagaaatgactctcgcgacacgcaccgccaccgacaccctgcagcagaccttgccctggggcacccacgaacgtctcgtcttcgggcgggcgctcctgcgcagcaccggcttcccagccgaaggcttggccctgctcgactccgacgacatcctccccctcctcgactcctttcttgccggggacatcgacagaactcacttcgagaaggaatacaccagtcgcgaggagtccggcgcaagggcgctcatcaacgtcttgaaggacgatgcagtatcgcgcgccatcgcatggcagaaccccaccgcgtggaggtccttcgaatccctgtcgtccacgagcggaatcaatgcttcgactcggcgcaaggtacgccaactcgccctctactggcaacgttactgttccaaggctgagaccattggatacttcggcccgttcgcctgggccgaagtcgacccggaggcctctgcggtcgaattcatctcctccgaccatctgatcgaccgttcccacgtcgcaatggaggcgtgggcggtcattgagatcgggaaagccctggcatcacgggccgaccttcagtggtggatgccaccaatcctgtcccccgccgtcgacctcaacatggagagaggcaccgtgacggtggctggacaccagccacgacgggtccgggaggacgaggcacgagttctcttcctgaccgacggcacccgtcccgccgcccagatcgccaagagcctcgacatggagcccgagcggttgcgcaggatcctcgtggcccatgaacgtcgtcacaccgtgatctgggacgccaacatccctgtctcagtgcacgcgtgggacatcctgcacgaacgcattgcccagatcggagacgctgggctgcgagatgaggccactgctgttctcacgaggttcgacgagcttctggaggtcatccgcaacattcccgacgcccggtccctgacggaggcgacggaatccctgtcccgtcttttcgaaaccgtgacaggaacctcttcgaacagacgtgcgggccaggcatatgcagcccgcagcctgtgctacctggactgcacccgcgccggaaccgccaaggttgggacccggcttctcgaagccctcgacgcccccctcaacctcgtcctacaatccgctgactggttcgcggcgaccttggcaaaggaatacaccaccgaaatcacggacctcgcaaatcgaaagcagcgggcctcccaccagccactgaccatggctgatgtctggccgtccacgatgtcgctgttctggggggactcaccgtccccactgcagcgagccgtgaccgaactgtcacggcggtggagcagagtcctcgaggggctgcagccagtcgacggtcgcatcgacacgacatcgtccgctctctcgggcgccgtggacgagcagttccccgtgtgcaccccgattccagaactgtcagtgcacagcccggacctccaggtcatcacctcgagcactagcaacatcgcctccggacgagtcactgcagtcatgggtgagctacatgcctgtctgagcagtctcgacatgccgttgctcgagtggtcgctgccccatggttccattcgcgatcgcatcaacaccgcgctcaacctgcgacgtctggttcccttgttccccgagacatggaggcgcaacaccggccgcatggttccagcgacggtcggagtgggggatcgcgcaatcgggttcactcggacggccgatcaagaccgtgcgaacacatggtcgatgtcggcactgctgttcgagcagaccgaggacggactcatgatccgtgatcccgatggcaggctctggaccatcgcacaagcgtggagcgtgcccatctccatggtcgccgccgatgcgttcaagatcgggctgcccggctcaccagcccctcggctcaccattgacaatctcgtcgtgttccgtcgtacctggaggtttcccgctggctccatcgacatcatgcacggttcagccgccgagaaacacgctcggctgagggagtggcaggtcacgaatcaccttcctgaccacctcttcgtcaagttcccctccgaacccaagccgatctacttctccttcgagtcccccgccatggccacggtcttcacgcgatcactgcagcgcgacgcccgagagaatccagacagtctcgtgacgatgtccgaagcactgcccgagcctcaatcctcatggctgcacgacacccggagccaccactacgtccacgaattccggctgcaactgaccaaggagcgacatgacgaccacagttgagacacatcccgaaacacgtggcacaaccgcgacatccatctccaatctgatcggtcacacccctctcgtaagaatggaccatctgttcgacggcctccccttcgaggtgtacggcaagctcgagaagctcaatcctggcggaagcatcaaggatcgagcagcacaatccatgatcgaacgggcaattcgacggggtgagatcgtcccgggccgtacgaccgtcatcgagtccagttcgggaaatctcggcatcgccgtggcgatgctgtgccaggagcacggcctgaatttcatctgcgtaaccgatgccaaggccacgccaacgaacattcgactcatcgaagcgttcggggccactgttgaggtgatcgaagaacctcatcccgagagtggcgaattcctccccatgaggctcaagagggtaagagaactgctgtcagagattccagatgcatggtggccgaatcagtacgggaaccccgacaatccggcggctcacgagcggactgtccgcgagatcatcgaggcaatcccgcgggttgacacgattgtctgcgcgaccggctcgtgcggaacccttcgcggctgccacgaagcattgcgaaagctgtccccacgcacccgactcgtcgccgtggacgccaagggcagcgccatcttcgacgaggcaggagcaccccatccccgctgtgtcccgggacacggtgcgtcagtgcgaccgccgctgtggcgcgcggggctcgccgaccaactggttctggtctccgacgcggactgcgtcgtgggatgccaggaggccctgcgcaccgaggctcttctcctcggcggatcctcgggagcaattctgacggccattcaccgagtgtctcccacgattcccgctggttccaccgtggtgacgatcctccccgacggcggcgagcgctacatcgacaccatctacagccgctcgtgggtcgactcacacatccccgggctgccctctctcgccgactggggggctcccaaccccgccaattcgtatgacctgaacagaagtgcctcatgaagctctacaccagagagaccgtcgaaactgcgcttgtcgggcgtcatggccaggttctcagtgccgtacagagtgcatacatgctgcattcgacgggagagacatcgctgccattctcaaccttcctccgcccggccgggtatccgaacgatcggatcatcgcacttcccgcccacatcggaggcgacttcgacatagccggtatcaagtggatctcatccttcccggaaaacctcgaccggggccagcaacgagcttcctccgtactcatcctcaatagtctggagacgggatacccgaccgccctgctggagtccagtcagatttcagcaacgcgaacggcagcatcagccgccctggccagcgccaccctccatggctccgaagaccatgtcagcacgattggcatcatcggctgcgggacaatcaatcttgcaacgatcgactacctcttccacgtgcacccccagatcaacgaggtcctctccttcgatctgaggcgggagcgggcccatgagttctcgcacctcgtcaaggcttcgcacccagaggcccgggtccgtgtcgccaaggagcccgacgagattctggccgcaagcaacaccatcgcgatcgccacgaccgactcgagtcattggttggaccttccgccgtggcacgggccggggcaccaagtcgtcctgcacacgtcgctgcgagacctgtcagtgccctcgatcctggcagcggccaacgtcgttgacgatcctgatcacgtctgccgtgaagcgacgtccttggatctggcaactcagcagaccggcaaccgggacttcatcacggggagaatcggagacctccttcttggcgcgccgctgtcctcaagtcctgactcccgtgtcattttctcacccttcgggctcggcatcctcgacctcgcagtcgcctccgtcgtcattgctgccgcctcctcttcagcagtcgagatcaatgggttcgaccccgggaaacacgccacaagcatgattgaggtgaatcgatgaccaccacacagatcaacgacaacacggccgttctgcgcgacgtattccccgccggctccgtcgcattcgtgagcggtgcctcacgcggaattggcgctgcctgcgcgacagcccttgcggccgcgggatgcaacctcgccatcacttatcgaaggaaggagaacgaggcggcacaaatcgccgaatccattgaagccatcgggcgccagtgcatcacaatgcagatggacgtaaccgatgagaaccaagtgaccagagccttccgcatcattcgccagcattacggacgcctggacgccgcggtcttgaactcgggaatcaccagtgacgggcatcttgcaacaatgagccgctccaagtggagctcggtgatcgacacgaatctgaccggaaccttcctctgcacgcgcgaggcgaccaaggccatgtactcgtccggtggctcgatcgtcatggtcgcgtccaccagtggagttgcagggcgaccgggccaggccaactacgcagccagcaagggcggaatcgttgccatgatgaagacgctggccccggaggttgcggcaaagaacgtccgggtgaatgcggtggcacccggcttcattcagaccgacatggtggcggccgttccaaaagcggcactcgcccaggcaatccaacacatccccatgggccgtcttggcctggcacaggaggttgcgtcagccgttaccttcctggcctccccgctcgccgcctacatcacagggaagaccctcactatcgatggcggaatgatcaacggctgaccccaggacccggacacccccagtaccgagaaaggaacaacaatgaccgagatcacccacactgccaacagcatccgaacccgcgccgaggaacgttccaacaaagcttggcgcctgaaggaggagatcatctccaagctcggtctcgagaccaagccagaatatgtctcggacaaccaaccgctcttcggacgtggccttgagatggattcccttgacactctcgaagtcgtcgtcgccgtcaacaatgagttcggagtctcggtcaacgacgacgacgtacaggcgttcggctcgatcaatgccatggtcgatttcatcgaggtgaacgagaagtgagttctcttgcgctcgaggcgccacccaaggacgcccgtaagaaattcgcctacgacagcgatgccatcaagacgatgctcccacatcgttggccgatgctcatgattgatcgcgcctacgacgtcgtcccagggaaatcgggcaaaggcatcaagtcggtcagcgtcaatgagccgttcttcgccggtcactaccctgaccattccatcatgcccggcgtcatgatcgtcgagtcgatggctcaactcgtggccgtcatctacgtagccgaggccattcagaacaatcccggcatgacgtcgcacgacgcacgttcaagcgttggttatctcggcgcgatccatcagatgaagttccgacgcctcgtcactccgggcgaccaactcaccctccacgcccagctcggcgagaaagtgggggctctgcgcgaggtttccgtgagagcactcaatggccgggatgtcgtcgcccagggggaactcgtcgtcaccgagcggtgacacccagccacacacgagaaggaagtcccatgatcgttcgcccctacaggccacgtgatgcggaagcgatcgtacatctctacaacagccattccgactcccccaatccagtgtcgggagggattgttgaggaggagttccagagggagctcgaagaacgtggttcgacagtgttcctagtggccgaggaggccggatccattgtcggcacattcgggatgttccgcacgaatggccgacacaccatggccgatgatgaagtcttcgccgacatgttctatgtcaccccgtcacatcgactctcgacagttccgggacagctaatcactgaagccatcagcgagtgcttcatccagggcatcaacgtgatccgcctcaccgtgaaccccgcgaacatctccgcgctcaaggtttacagaaaagtcggttgtgcctgtctcggggccaccgatgcaggcgaggacgggaacattgagctgtacaacttcatccctctggttcttagggcaaccatcaccaaactcgaccacgattgtattcgagccctggcggacatgacttcgttcgcctgcatcaccgagggacgtccacttgatctgtcccacgacttcatcgtggacgctggacggaagatcgtctcccacagcatccagatcgggcgttcaaccatccacgccatggtcgacacgggctcgaggaccattgtggaggccaccctcgacaaccgcgactgggatgctcctcgccagatcgtcgcccccaccccctgtcagaaccggcccgaggaacagcgaggcaaccctgtccggctggtgcacaagaagcttgaggtcaccttcaacgaaggagtcattgagatcagtacgactggccactggggcccggtcctcgcaatgtcctggccctcctccgtctcgcaccgcgctcacgggtggcgacagggccccgccaagtcgtatcgatgcgagcttctcgagaattgcctcgtcctggatgacgaaggaggagtgaaatgcaccatcagcctcaatgattgccaagtcgcgatccggatggatggtgccccaaaaacggaattgagaatgtaccagtggtgcagcctgcgccagggctatctgacggctgacaccggcatcacgagcttcaaccgggcatccagtgggctcggagtcgccgtccgggactcgtccgagattgtcgccgcgggccttcccgtcatccctgacacaccgatcacatggagtgagggtgacatcacggttcagctcgatccctgcggccgcgcctccctgatccactcgaccctggtggaccgaagaatccacttggacgagtctggctcggcaagtctcaccatgaccgtgtttggtgactcccagccccatcgtgccgacaccgtcgagctgcctcccctcgcggcaggcaccgacaggatcgtcctcaagccggctgccggaggcgtgaccacatggcgcttgggcgccaccaaggtgctcaagtcaccgtggccacacgcccgcgcgctcgggcccaatccgatctggcgagccggcctgtgggtcagtcacgagccggatcgccacgaccgtcgccaaggaatggggtggggtcccgatcatcgcagttggaccctgtcggaagacaccatgaccagtactgacgggacactctcctggcgcttcagcggctcccccgacaccggctggacggtcgacgtcacgacgagcaacacgcacggggagaccgtcgtctggctcaccccggactgcccggcgggcgagaggatccgcacgtctgatcatgccgtgacgaccatgcttgacatctcgaagccatggcagcgctggaccacccgatgcgcaattcctctcagacacgggaagtggttcctcatcgagcctgatcatgacctcactgattcccccgaaatcctcatgcgctctgttcacggggtcctgctcgtcggctgtgtcggacgagcccactccggatccgcttcctggcgctttgccatcacgtcagaactccccacctccaacccaagaagaaacgactacacctcagccgcctgaacccaaccagttggaacacccactacagaagaaatggagcaccaccatgtccatcactgagcagtacaagacccttcgcacctcggtcggcctccacacgcctaccggtcccctggtccgtatcaccggtgatgatcgtctcgagtttctcgacaccttcctgtcccgcgcctcggacttcgtggaccccgacaccactcgggagtgcctcgctctcaccgaggacggccttccgctgacgatcttcctccacatcgagcgcgaggaggagtcatggctccttccccgcaccgccatcgatgcggcgaccctcgccacgtacctcggcaacctcgagaccgatggtgacctgtcaatcgagattgctccagagggttggggagctgtcgctgtcgaggggccgctgtcgtggcagatcgccgaaaaccttctcgacttcgacgtggctggcctcgttcttcacgccgtcacggacgtcgtcgttcccggggcccccgagggatcgaaggcatggctcgcccgggtcggaaccactggggagtacggctacctgctcgtctccaacgttcccgacctcgcccgcacttatctcctcagccgcgccacggagctgggcggtcaggcagtcgacgccgatgctctcgcacgagtccaggccgaggccgggatgccctattacgcgatgggcgtgtgccacctcgatgtcgccgggggtgacctcgcctggctcgtggactggcagcgcatcggcgagttccaaggatccgagaatctgcccacacccgtccgagaccagcgccgactggccgccatcgccctgcccaccggcaaccgcccggaagctggtcagaccgtcgctgccggggatgaggagattggagtggtggtgtacgtcaccccgtccgccaatcccgatgaggaactcgcgttcgcacttctggatgctcctttctggactcccacccttccgttgaccgtcggtgcccacgacgggaccacggtcaccctgccccgcgtcgtggcagcctccagcctcaacaagctggggtgacagcgatgacgatcactgctgagaacgccaccacccgcagcgacattgcccggagcattgcggtgaccggcgtgggactggtcacggcacagggtgaccataccgacgagtgctggaccgaacttgtcgatggggtttgcggaatcaccatgaacgtcacgttcgatgactctggcaccacgattccgtgtgctggcgtggctcccattccgaactctgattcgatcgaccgctgttacctgctcggcgtccatgccatgcgtgaagctctcgagatgagtggcatcgacctggactccgtgggtcgtgatcgcatcggactcgtggtgggctcaagcctcggcgcgatgcccaccttggaggcggctcatcgccgggccattgagaccggcgtgctcgatgccggattggcggcagactcccagctcccctgcgtcgccgaccacctcgccgctgagttcgacatccgtggaccccgcgtcgtgacatcgaatgcgtgtgccgctggtgccgtggcgatcggctacgccgcagaactcctctggtccgacgatgtggacctggtcgtctgtggcggtgtcgatccactggcccagatctctgccaatgggttcacgtgcctgggagctctcgacaatctcccatgcagcccgatggccggttcctccggtctgactctgggcgagggagccgggttcatggtcctcgagagaacagatgcggcggctgccagaggccaggaggtgatggccgaaatcgccggctacggcacaagttgtgatggttaccaccagactgccccggacccgggtggcaatggcgcccgcagctcaatggaggccgccctgcgctcagctcatctcaagccgtccgacgtcagctacgtcaatctccacggcaccggtactccgaccaacgacgccgtcgagccgaaggcactccggtcattgttcaagtccgatgaccttccccctgtcagttcggtgaagggcgccatcggtcacactctcggcgctgctggcgccatcgaggccgtgtgctcgatcaaggccatccacgagggggtcctgccgccaaccgtcaacaaccgcgggcaggcttcccgaactggtctcgacatcgtgccggagtgcgcacgcaaggccgctcccgacgtggtcatctccaactccttcgccttcgggggcaacaacgcatcagtggtcatcaccgcacctcgaggaggcgttcactgtaccgccccggcgcagcttcgcgaggtcggaatctcaggaatggcagctctggcgggaaaggccgccaactcggaggagcttctttcggccctgtcagaagattgtccaatctggatggccgatgagaagacctgggaaggggatgctgtccaaaccggccatgtggacatcaagcgcctgtcccgcacaatcaacccgtccaaggttcgtcggatggaccccttgggaatcatctccagcgcggtggtgactgatctgtatgcccgacacgggaagctgagccgcaaggatgccgaaagcacgggaatcatcttcgcaaccggctacggtcctgtgacggcggtgacgcagttcaatgacgggatcatccgccacggttccgagggtgccaacgccctggtgttcccgaacaccgtggtcaacgcagccgcaggccacctcgcgatgctgaatcgctaccgtggttacacggccaccttggcatgcggtggaaccagttcactcatggcgctgcttctcgctgctcgcgtcgttggccgcggcgctgcggatcgcatcatggtcgttatcgctgacgagtttcccagcattgccgtccaggccgtcgcaaagcttcctggctaccgacacagggttgatggttccggagccgtgctctcggaaggcgcggtatgcgtcctggtggaggccgtcgaagtcgccgaagcacgcggtaccgcccccatggcgctgctacgcggcttcggatcccgtggagagtccgtgggagtcggtcacaccgcatccgatggacgggcttgggccaaggccatggccgctgcactgggccaggccggcctgactgcctccgacgtgtcgaccgtcgtggcggcatcaagcggacatcctcgcgtcgaccgagccgagcaggcggccaggcggatcgtcggactgtccgcaaccgctacgaccttcccaaaggcgattgtcggagaaacacacggatcggctgccgggatcgggctgttcggtgccctgtgcggttcgaggtcagccgcgcaccagaacatccttgtcaacgccttttcccacggcggtggttatgcctcgatggtggtggagtcactgtgaccacgacgcttctgccacgggttgcccagccgggaccgggcgtcagccatgtcgacaccgaccgtcccatcgagtgcatcatcacccaccacccccacatgccgcgtgatcgcggaggccacgccacctccgtgtcaggcaggtacttgctgcgccaagccgcagaactcatgctcggcacggatcctgcgcattgccccgtcgtcgacccttcgcggcgctggtactggcccggaatcaatcttcacggttctgtctcccatgtcccgggctggagcctgacgacgctgagcaccggcggccacatcggggcagacatccaggacttccgggagcgtcccggcgcaatggcattcatcggtgacctggtcaagctgtcgcgatcggcgtcactccgagaattcgcggagtgcgaggccgtcgtcaaggtgtccgaattgactaaggagacgttcgggcacgtgcgactgcccgaatggacacccggatggcgccacgttttcgaggactactgggtctggagtctcgagatgcacgggatgggagtcatcgcactcgcatccgatctcccccgagccattcgctggtggcggtgcgacgccgatgcccgtggccgtctccaggctctccgacccataagcagtcttggaccaggaaggccgtcatgagccggtactcacgtcgaatctcaggcatcgaacgcggctatctcaacgccgcaacccggggcccgcaccccaccatccacacgatgatcgacttcgagggccgcgtccccgccgactgttggcggcacgcatccacgattgcgtcggccgccaaccctggcatgacagtggtccggaggtcgggccgatggacatccgatccagcgggctgtccggttgtgttccacgactggaccgcggaccccaacgacgttgccgacttccacgctgacatggatctcgtgacgggaccatcgtccacgctccacgttttcgagggggcggaacgcacccgaatcaccttggcagcaagccatgccgtgaccgatgggcggggcatcgaacgatttctcgtcgacctgcttgcagcgttggacgagcgtgaacccattggaagccccgacaccctgaccgatgtcgatatcaaacgatccttggagaacagcatcaagccccgacgccacctggccgctgtgcccgccgatgtcctttctccactgggggggaggaagaaccaacgtatatgggcctccaggacgtggcacagtgccccgggagccatgagcggaagaatcgctgccgctgtggccgagatgatcgaccacgccgcaatgatcatcatcccggttgacatccggcggcacgtcccagaggtccgatccacagcaaacctaagtgcccaactgccagtgatcatcaccccgaaccagcgctggcaaagcatccatgggcatctgctcacggaccttgctcgccatcgagaccttgcgatcatcagtgaggatttccgccacaacaatccgttcgcatcgaccttggaggaaagccaggccatcggcctcgatggtgtctatccctgtgccgcaatcatctccgaccacgggaagctcgacctttcaaggttccagaccttggaactcaccccggtctcgatgcgaagcctcccgatgctcgttccctactccgcaatgttcatcagcagttgcaccgtcggcgagaccaccactgtcaccatcgctcatcgcgctgatgacgatcccgattccataaacaccttcttccaccacatcgaatcccagatgtccatctgagccacgtcgtccctggagagcaaacatgaccacccaagatgtcatcaccccgccgcgccccgtcacctcccatgccacggcgaccaggtccgaggctccaccgcgaagcgtcatcagagccatggccatctcgatggtcgcgaccctcatggtcatgctcgacacgaccgtcgtgaacgtgtccttgagcgcgaccaccgcccgcttcgggagcatgggcagcgtgcagtgggtcctcacaagttacctacttgcactgtgcgcgacgatgacggcctccgcctgggtcatcgaccgccttggtccacggctcaccttcatcgcctcaatgaccatgttcctcatcggctcggtgatgtgtgcactgagcgattcagtgtggcaactcgtcactggcaggaccatctccggtgccggagctgggatccttgttccgacagcatccgtcctgcttatccgtggcatcccacgcgaacaacttggcagggtgcaggcactgaatgggagtgtccagttgatcgctcccctgatcggcccgactgtgggcggtctcctcgttgacaggtgcgggggctggccggccatctactgggcgaacgtccccgtagctcttgttcttctgattgaggccgtccgcgtcgatccggacgaaccacacaccgctaagcgccgcctcgatgctctcggcctggtctgtggcagcaccgcgatcgtgctgacagtgcttggtgtctcactcttcggcaggacgtcgcgaaacaccaccttcctgcttacgatcggcgcgcttgcagtcctcgcatgggcgttcttcatcacccacatccgaagggctaccaaccctctgcttgacgtttccctgtatcagaaccctgtctattcatggtccagcttcaacgtagcggtgcttggtttcggtctctacgcccccatggtcgtcatgcccctctatctcgaggcgacgcgccacctcactgccgtccacactggtctggtgatgtcagtggccggcgtcggcgtcattatggccggaatcctgtgcacgaagatcatgggccggatcggtggaggcctcacgatgacagttggcataactctgagcatcatcgccactctgcccctggtccggctgacgaaccacacctcctacatactcctggcagtctgcttggccttgcgtggagcaggaatcagcctgacaatcgtcccagccatgacacgggccttcgagtccatcaagaggacggccatggcggacgcctctgcacagctcaacctgttgcagcgaatcggcgggacaattgcgacagcagtcatcatcgcagttatccaccacgaggccatgctcacccgcggactctcccccacagtgttctcgcacgccaacgtgtggatcctcaccgcgaccgccgtcacccttctgccggccttcgcgcttgcgaaggccgaaagacaacagcaggatctctgagcaccgaggagtactccctcgtagaccctcctctgatctaattgggttcgttccaagtgtgtatctcactccggggagccccgattgctgaaccacatcccgttcaccctggcgagtccctcgtggtacgacgtcccctgggcgcccggatctccgtatctcacaggagatatctcggtcctgccagcggactcgccaaggtggacgacgaccatccggggtccttggcaaatccacatgccacctcgtccgacccttccagaggtggggtggaaagtgcatgtgtctgccaagccatcggaattggaatcggttgcctcagtcgtagcactgtggtgcgtacgccacagcgtccccttcaaagtacttcgcacccgaggtctcgttcacgcgagtcaagtcaagtatgcggaccgaagtcagagcggcaaggtctgcacctgctaccccgacggcgagagccttgagcacttctgctccggtcttgccgagctgcttcagaacgtcgattcacctccggtgtccggcgagctgcgagtcggatcctcccctctgtggttgcgtcacgggagtttccgagaggcatgggcggtgtcatccacaggagtaccgttcccggtctacccgggaacaacacatcctgatcgtcgaggccccgcgcccgcagaatccgatcacgacacgccgtggatccggaggctccgtcggacgaatcgccccagcacggttcttcccatcgacgatgtcagactcctccaccaatcaaatgctggcggcgtgtatcaggcaacatggagagacggcacatcggtagtcgtcaaggaggcccggcacctgtccggacttgatgcggcgggtgtcgacgcccgagtgcggctgcgtcacgagtacgaggccctgagaagactggacccctatcgggccgctccccatcccattgatctcattgagaccgaggacggctcgttcctgatcatggaattccttgacggaatgacagtccaccaggagatgtcgaggttccatcctctgattggtaggcgacctcatcggctatcgatgaccgatttttcacgctggtgccgagaggtcgaagatcgcttgaggaatgtcacgagggtcatggccgggtgcggaatcgttcacggggatcttcatcccgcgaatctgatacatgtcggccatgaggttttggttactgactttgaatcctgctcaatcgacggggtcgccgtctcgtcagggatcgccgctccctggttccagtcggacgacacgattcccgatccggcgacgactgacgatctccacactcttctcgtggatccgacttgcggccccgcgcttgtcctccatccaaatcttcgcgcgctcatcagccaggccgcagtcgaggacatgatgggaaatccgactggtttaccacatgcctggaacctcgaggacgtgacaagcgaactcgccaaggggatccgggcatcagccactcccgcacgagccgaccgcctctttccctcagacccctacctgttcgggcatccaggttcagaattcggcctgatgcatggcgccgccggaatcatggctgctcttgccgtgactgggtacggtgttgacgcgaatcacgtgacctggatgaaggaccgcttggccacccgcccgaccctgctgccggggttggccaacggaatcgagggaattgccctgggtctctccctgtgcggtcagaacgacatggctgcatccctgctccaccagtccggaattctcacgatcacaacgaacggatcgactgacctcaccctcggtactggtatggcgggccgagcgtgcgcgctgcagtccctctcacaacgactgtcatcgaaatctctcgcccacgctgcatataccctctgggaacaactcgccgtggctgtgcggaacactgatgtggccttgccgaacggcctgttctccggttgggaggggatcgggctctccctgcttgcctctcccctgccggatcgtcatgatctcgcccgccactcactccgactggccctggccacgacaacgattgttgacggtgcgctcttctcaggcgagggacagatccgatggccatatctggggcgtggtcccgcggcatgtggcccgctcgccgccaggcttgatgatgaccagacggccaaggccgtggcacagacctgtcgttgtcccctgactgagtcatccggtctccacaatggccgcgcaggtctcctactcgtcctccgccagctcgtgggagaccaagacgacgccgttcgccgccacctcatgagactgtcgtggtcgatggaccgtcgcgaggaaggcacattgctgctgggtgatcatggcctgcgtttctcatccgatctcgcgacggggtcagccggcgccctcctcgccctgagcagggacccatggcggaacatgacacgaatgctcggaatatgcgatgacacctgtcatggcccactagtgacagtttgatctagcgccgatagttcacaactgaaagactccaaacatcgaggaaaacatgctgagccaaaacgccttggcaggcgtggctcgtttcaccacgatgaacaccaggagacagaatgtccgttgaggccatgcaatccatcgagatggacgaggaaaacagcgccagccagacagtttgcgcttgttacagcttcttctcgtggtcaggatgctgcgtagtctcccaagcggtggaagcatcttgatcgtgtgagacgccgtcgactaccctgtcccccgtggtacgcacacgccccgtcctggacagtcccggaagaccgctcatcgcctccggagtcgtcctggcggtcctgctcatcatcgcggtgatgacgatggtgcttcagcgcgaccccactctcacccccggacgccgcattctcggtatcgtcctgtccacggtccaggccgtcggattcatgtggctgcagacccgcatggttcgtcacggcaagggttcgcgcaacatgcgtgcgacccttggaagggtcggtttctgggccacgtggggactcgtcgcagtgggagtcgtcaatctgtggctgaccaactcgtggaccctcttcggggcctccgtcgccacgcccctccttctcctgccaggggtgtggagtgtggtggccaccctcgtgaccctgatcgtcggtttctccgacctcgtggtcacccacacctcgccactgacctcagccacggtcgtgctggtgaccatcgcggtgtcggtgaacctctacgcattcacgaagctgtcgacggcactcgttgaactccgctcctcccaggaggagatcgcccggctgcgcgtggacgccgagcgtcaccggatatcgcgggacctccacgacatcatcggtcgcaccctggtcgccacgtcgatgcgccagcaggcggccctccacctcgtcgaccgcgacccgcaacgggccaaggaacagctcgacgccgcccatgacgcaatcaccgaggggcagcaccagttgcgttccatcatccaggccgagatgagcaccagcctccccgacgagatcagcgacgccacattcctgtgcgaccgactccacatcgacttccgcatggatgaccgcggcagaccgcacaaacccttcgactcggcggcggcggcggccctgcgcgagggaatcacgaacatgctcaagcacagcgcggcgggctactgccacgtcgccatctccccggacctcctgaccgtcaccaacgacggttgtccgcaatcacctcgcccctccaccacaccgggcaccggaatcgaccatctccggtcccagatcgaggcgctcggtgggtcggtgacgacgtcgcggccctcgcggggcaccttccggctccgctgctccttcccgacccggggggcgtccacgaccacacccgcgaccgaaggaggacgatgacgacgagaatcctcctcgccgaggacatcaaactggtggcagaggccttcgaggcactgctctcggtggaaccggagttcgaggtcgtcgcacgggtggcacgcggcgacgacctggtcacatccgccacccgcctgttccccgacgtgatcctggccgacatcgacatgcccgggatgaccggcatcgaggccacccgaatgcttcgcgacaagggataccgcggcagaatcatcctgctcaccgccctgccgggaagcgggcacctgcacgccgcgatggctgccggagccgacgggtacctgctcaagtcgatcaccgcgccctccctcatcaacgccatccgggcggtgtgcaacggccagtcggccatcgacccgaacgtcgccgcggtcgccatgcgcaagggaccctcgcccctcaacgaccgggaaaccgagattctgcgcctagtcgccgacggttcctccaccgcgcagatcgcctcgcggctgtacctcagcaagggcaccgtcaggaactacctgtcgacggcgatgtcgaagctcgacgccgactcacgcacagcggcggtcacgcgggcacgcgaggagggctggctgtagcaggcgacccgctcagcccaccgcccctcagcccaccgcccctcagcccgccgactcctgacgcacggcctcctcgaccgcccggctgagcagggacccggccctgaccatcgacgtctccgggtccggctcgaggtcggacaacgcgatgatccggtcgaacgcggaccgtttctcctcgggcaggtcacagcgtccgcacaccgcccagacgggcaccccggcgtcccgggcgatcttgcggatggtgtcgagaagcttgccgagcagggtctgctggtccagccgcccctcccccgtgacgacgagactggaggcggagatccgcgacaccgcgcgggaccatcccaggacgaccgccgcgcccgggcggtacctggtccccaggcacatcagcgcccagccgacccggctgggcggctgcgaaccccctggccaccgcccggcaggcctttcccgaactcagcgaccccttgaaggagtcgacggcaacgatgaccggcgcattcggatcaggacgcatgggatcagcatgtcacgtcgatacggagcagtcgcgccgcctacccctagactcgggggcatggtcaaccgagtctacctgtccctgagcgttctcgccctcgtgctgtgggtggtcgcctaccgtcacatgccgggctgggccgcgggcatcaccctggtgggcatcgtcgtgctgtcgctgtggtgcgagtggtcgcgggtgcgcaccctggccaggatcggcaagtcccgccagcagggcccccgctcctcccgaggacgcaacctgtcgtgagcaatacgattcccgcagccctccaccccggccctgacgaggcc

SEQ ID NO: 433 - DNA, 26636 bp, Propionibacterium acnes
ccttgtggacaccacgtcatccacatgacttgtgtcacatgattcccggaccatcatcaagcagatgctcacccaactgtaatgatttctgttctgaatctggacatgctctgacctgcattcaatgatcaattccgtgcgatattccacaacgcacggagaggtcgcagacaatgacaacagaaagcatccccacgcggctgctcgtgtggcacgagcagaccgatccgaccaagctcctcaggatcaccgacgcgatcaggaggggggatccccttccccccatcgaggccatggcgatcggccacaaattcctcgtcctcgacggtgcgcaccgggcccaagcccaccagtactgccatcgatctgagatccgagcccgcctccacaacctccccctcagcgcggaagtaccaggctggagccactccataccccgcgatgcagcagcgaaactggctcacctactcctccccgtggacgctctcggtcaggcggaacatcgtcctgcacggggtgcgccgtcaggtggggaccgcttcacaacgaccgcgcgacatctttctcgcctgccaccggatcgcgcgagttgcctacgcgcatggaatcagacctctcggcccggagttctccaacgctccgacgatcgacgccgccaccatgacctggcccccgccgaacgtgggcacgttgtgggccatcgccagcagtctcggacccctgcccgcaactgtgacccggttcgccccgatcctccggcacgacgccatcggggattccgcgatgacacccgtcacctccgccgcgtgacgacccgcgccaattccgccccaccactggatgaggggcagccgcgtggacgatgctcctgttcaggcagggactccatacgagaccaataggaaaatcatgatcaaaaacacaagccctctgaccgtgaaaaatgtctcgaaaacattccgtggctccagcggagaagccatcaaggccgtgcaagacgtgtcattcaccgttgagcgtggtgaggttgtggcattcctcggcccgaacggcgccgggaagtccaccaccatcgacatggctctcggcctcacccgccccgacagcggccagatcgaggtcttcggtactgacccgctcagcgcggcccggtcgggacgctgcaccgcgatgacacagaccggcgggttgctgcccgacctcacgattgggcagaccatggagatcatctcctcgctctatcgtggctcccacatgaatgcctgcatggagcgagcaaggatcacgcatctggccgatcggcaggtgtcgatgtgctcgggaggcgagcgccaacgacttcgcttcgcactggctctgctgcccgatcctgacttcctcatcctcgacgagcccactgcggggatggatgtggaggcgcgccgggacttctgggcagagatccacgaggacacgcgtcgtggtcggacaattctgttcgcaacgcactacctcgacgaggtggacgagttcgccgatcgggtcatcctcatcaaggagggccgcgtcatcgccgacgacacctccgacgcgatccgcaccatgtcggggggttgcaccgttacggcgaccattcccgacttctccctggcacgactgaatctgccgggcacccaactcatcaagcagggcggcgcacgcgttgatctgcaccatcccgattccgatgccctcgcagcgcgagtcatccagctcggcggcaccgacctgcgcgtggtcccccgcagcctcgacgacgccttcctcgctctcacctcaaccaccaaggagtcctgacatgaccgcccaagcgcttcccgcagtcgccactcccaaggcccgccaccgatccgccatctcgctgaagtacttgtggtgcgagatgcgtcgccccttccggcgttcgacgatgctgttcaacctcgccctccccgcagttctgtacctggccctgttccgcaccgtccacaccgccgagctgccggacgggaacttcgcgatgtggatgatgatcggcatcgctgtctacggagcggccactgcgagcaccagctacgcagcctccatctccgtcgacgaggccaacgggtggacccgcaccatccgcctgacgccgttgtcgtcggtcgggtacgtgctggtgaaggtcctctgcgccatggccatcgccctggccccgaccctgctcatcggtctcatcgggctgttgaccggagctcacggcacgctgcgggtctgggtaatcggactgggggcggcttggctcagctcagcaatcttctccgccttcggcctggctctcggactgtccctgcgtcccgaggtcgtcatgcacgtccccggcctggtcatcaccggtctggcgttcctgggcaacgtcttcgtccccctcagcgggacgatgctcaccattggccgctggagccccgcctacggcatcaccgcgctggctcgttacccgctcaccaacggcatcgacatcgggggcggccacgactccctgacggctgccctcatcggcaccttctgctggttcgccggattcgtgttctgggcctcccgtcgatttaccaagagcacgggtcgtcagtgacagattcggccgatctccggaaggagcagtgttatgaccaagcccctcattgcagtggtcaccgcgggccaaggagcgcagaagcctcgcctgctcacgccatggctcaaggtccccggcgtcacggagaagcttgctgcatggtccgctcaggccgatgtggacctcgtcgagctcggtaccagggcgaatgcagaaaccttggcagcgaccgagaatgcgcagccactactggtctgtctcggagtcctcgtctcggatctcctgaccgaccagaacattgtgctcgcaggacactccgtgggcgagctgacagcagcgtgtctcgccggggtagttgatcccgggacggccgtcactcttgcacgacggcgtggactggccatggcgcgggcctgcgctctccacccgaccaccatggcggccatcattggtgacaatccggatgacgtcctccggcggctctcggaactgggactcacggctgccaacatcaacggaggcggacagattgttgcggccggctccaccgacgcgatcgcggaactggtggcgacccctcccaacgggaccgcagtcaagccgttgcgagttgctggcgcctttcacaccaagtacatgacacctgcgcaggacgctttcgcccaagctgctcaggacgtcaccttctccgacccgcagcacccgatcatctccaacctcgacgggcaggagatccggtccggcaatgacctgcgtgaacggctgattgcccaggtgaccgcgccagttcgatgggatctctgcatccagcagatcgcggatcgtcagccggaactcgccctatcggcccctccggggaaggtgcaggcgtcgctcttgtctcggcagatcccggacctcgcgacggtctgcatcaccacaccacgggaggcagcccaggctgcacagcggatcgaccagtccgtatccgtccttcagggggcatgatgctcatccccgagtacttcctcacagcctgttcggaccatgctgagcgcctggcgatcatcacccacaatgacgttgtgacgtgggccgaactggcgactcgcgtcgacggttttcggcgctggctgcgggaccatggcgtgcaccgccaggacagggtcgttctccagacgccaagcaccgtaggcacggtagccctcatgtgggcctgcctgctcgacggcgtgacgatggtcccggtgcaccaggacctcactgcctcccaggtgcagcaagtcatcgacgactgccgtccagctctggtgtgtggcagcccggacctcgtccaactcctcaactcccccggaatgaagacaagcacacctccaacgcggccggagtcaacgagtattctgccgtccttgtcccgggtcagccccgatgaccttgcgatgctcatctatacgtccggcacgacgggtctcccgaaggggatcatgtgtccccaccggcaggtcgccaccgccgcacggatcgtccatgactgtctcgggtaccgcacggacgacgtcattctctgtcgcctgccgttgtccttcgactacgggctctatcagattctgatgtctgccatctccggtagcgcggttgtcctgcgggacggaggcgcgcaggaccgcaacctggtgcgcgacatcgcccgtcacggcgtcactgtcgttccagtcgtgccgtccatggcgtcaatgctcatcaccctgcagcgtcgtgatcagttgccgaccatcgtcagactgttcacgaataccggggcgcgtctggcacccgagaccgcgaaccagttgctcgcaagcttccccggctcccgctatgcgtcgatgtatggcatgacggagtgcaagcgcatctccatccttccggtggaggagtacgagacgcatccggacagcgtgggaagagctctgcccagcactcacgtcgagatcgttgacgctcagggagttccggttccggcgggcgagcacggggagatcacggtgtccggcccgaccgtgatgaacggctactggcaggtgccgaacagtcccagtggacgattccgacccagcggccacggcctcactctgttcaccggtgatcgcggctggatggatgaggagggacgtctctacctcctcgggcgcgacgacgagatcgtcaagcatcacggcatccgaatcagcctgcaggagatcgagatagccgccgaagccgcgccgggcgtcgacgcagtcatcgctctcaagccggcctccgactcggcccccattgaaatcgcctactgcggcagcacgagtcccgagaacctggcccgccatctcgaaaccgtcctggaccgggcgcgacgaccccaattcatccaccaactccagcagatccccctgacccgtaacgggaaaccaaaccggtcagcagccgccgaggccatccgctcaagggcgtgacggcgaaggccaacacccacagacgaaaggaaaccaccatgacccaggccgagttcaaccagttcatcgagtccacctgctccgcgacgatcgtggatcccgaccgtcctttggtcgatcagggcatcgactccctcggaatgctcaccctcatggtcgctatcgaggacagcctcggcatcgaactggatcccgagtccctcgccgacggtaggggttccacgccctccggtcttctgtcccttgtcgagcagctgaaagcgacggtgtgacgacatgacgacgatggttccttgccgccgtgtggagatgccgcaactgttcgaccacatccccggaagcatctctctctcaggagggctgcccgatctgagcgtgctcccgagcaatcagatcgccgaactgacgtcccggatcatgcgtctcggctcaagaatcctcctgcaatactccaccccttcggtctcgtcctccttggtgccggccatcctggacctggcggaacgaacatgcatgtcaccggatccgcggaatctgatcccgaccgcgggttcccaactgggcctggccatggtgatcaatgcctttgacggcgatgagatcatctgtgactgcgccacctatcccggggcgctggccgccttcgcctctgccggcgtggaaacaacgggggtggccagtgacgaggaggggctcaacccagacgcgctcgctcacgccgtcgcagagggtcgggccaatggccgccgcatcgcagccgtctacaccacgcccaccttccagaatcccaccggctccgtacagtccgagaaccgccgtgcggccctgctcaaggtgtgtgctgacaatgacctcctcctcatcgaggacgatccgtacggcatgctgtccttcgacgggcagacgtggccagctctgaagtccatggacccacagcgcgtcatctacctgggcaccttctcgaaggtgttcgcaccgggcgtccgttccggctggatcgatccgcccgccaatcttgtcgagaaactccgcgctgtgtgcgagatcatgacactctcgccatcagccctcaaccaagcgatcatcggcgagtaccaccgtcgtcacggatgggacgaactgttggagggctatcgcgcctcctaccgcgaccgagcccgtctcctcatcggggctctcgaggctgaactggcaagaacgaattgcactggcacgtggacctggcgtgaaccacggggcggcttctacctgtggttggagaacgtcgccagcaccagcggtatcgacgttgcgcgtcgcgccgccgacaacggagtggccgtggtgcccgggaaacacttcgacgcagccggacacgattcgccgagcctgcgggtgtcgttcagcaattcacgcccggctgatctggtcgaaggagctcgtcgtctcgcccgtgcactggtgggagaggacgttcagaaatgactctcgcgacacgcaccgccaccgacaccctgcagcagaccttgccctggggcacccacgaacgtctcgtcttcgggcgggcgctcctgcgcagcaccggcttcccagccgaaggcttggccctgctcgactccgacgacatcctccccctcctcgactcctttcttgccggggacatcgacagaactcacttcgagaaggaatacaccagtcgcgaggagtccggcgcaagggcgctcatcaacgtcttgaaggacgatgcagtatcgcgcgccatcgcatggcagaaccccaccgcgtggaggtccttcgaatccctgtcgtccacgagcggaatcaatgcttcgactcggcgcaaggtacgccaactcgccctctactggcaacgttactgttccaaggctgagaccattggatacttcggcccgttcgcctgggccgaagtcgacccggaggcctctgcggtcgaattcatctcctccgaccatctgatcgaccgttcccacgtcgcaatggaggcgtgggcggtcattgagatcgggaaagccctggcatcacgggccgaccttcagtggtggatgccaccaatcctgtcccccgccgtcgacctcaacatggagagaggcaccgtgacggtggctggacaccagccacgacgggtccgggaggacgaggcacgagttctcttcctgaccgacggcacccgtcccgccgcccagatcgccaagagcctcgacatggagcccgagcggttgcgcaggatcctcgtggcccatgaacgtcgtcacaccgtgatctgggacgccaacatccctgtctcagtgcacgcgtgggacatcctgcacgaacgcattgcccagatcggagacgctgggctgcgagatgaggccactgctgttctcacgaggttcgacgagcttctggaggtcatccgcaacattcccgacgcccggtccctgacggaggcgacggaatccctgtcccgtcttttcgaaaccgtgacaggaacctcttcgaacagacgtgcgggccaggcatatgcagcccgcagcctgtgctacctggactgcacccgcgccggaaccgccaaggttgggacccggcttctcgaagccctcgacgcccccctcaacctcgtcctacaatccgctgactggttcgcggcgaccttggcaaaggaatacaccaccgaaatcacggacctcgcaaatcgaaagcagcgggcctcccaccagccactgaccatggctgatgtctggccgtccacgatgtcgctgttctggggggactcaccgtccccactgcagcgagccgtgaccgaactgtcacggcggtggagcagagtcctcgaggggctgcagccagtcgacggtcgcatcgacacgacatcgtccgctctctcgggcgccgtggacgagcagttccccgtgtgcaccccgattccagaactgtcagtgcacagcccggacctccaggtcatcacctcgagcactagcaacatcgcctccggacgagtcactgcagtcatgggtgagctacatgcctgtctgagcagtctcgacatgccgttgctcgagtggtcgctgccccatggttccattcgcgatcgcatcaacaccgcgctcaacctgcgacgtctggttcccttgttccccgagacatggaggcgcaacaccggccgcatggttccagcgacggtcggagtgggggatcgcgcaatcgggttcactcggacggccgatcaagaccgtgcgaacacatggtcgatgtcggcactgctgttcgagcagaccgaggacggactcatgatccgtgatcccgatggcaggctctggaccatcgcacaagcgtggagcgtgcccatctccatggtcgccgccgatgcgttcaagatcgggctgcccggctcaccagcccctcggctcaccattgacaatctcgtcgtgttccgtcgtacctggaggtttcccgctggctccatcgacatcatgcacggttcagccgccgagaaacacgctcggctgagggagtggcaggtcacgaatcaccttcctgaccacctcttcgtcaagttcccctccgaacccaagccgatctacttctccttcgagtcccccgccatggccacggtcttcacgcgatcactgcagcgcgacgcccgagagaatccagacagtctcgtgacgatgtccgaagcactgcccgagcctcaatcctcatggctgcacgacacccggagccaccactacgtccacgaattccggctgcaactgaccaaggagcgacatgacgaccacagttgagacacatcccgaaacacgtggcacaaccgcgacatccatctccaatctgatcggtcacacccctctcgtaagaatggaccatctgttcgacggcctccccttcgaggtgtacggcaagctcgagaagctcaatcctggcggaagcatcaaggatcgagcagcacaatccatgatcgaacgggcaattcgacggggtgagatcgtcccgggccgtacgaccgtcatcgagtccagttcgggaaatctcggcatcgccgtggcgatgctgtgccaggagcacggcctgaatttcatctgcgtaaccgatgccaaggccacgccaacgaacattcgactcatcgaagcgttcggggccactgttgaggtgatcgaagaacctcatcccgagagtggcgaattcctccccatgaggctcaagagggtaagagaactgctgtcagagattccagatgcatggtggccgaatcagtacgggaaccccgacaatccggcggctcacgagcggactgtccgcgagatcatcgaggcaatcccgcgggttgacacgattgtctgcgcgaccggctcgtgcggaacccttcgcggctgccacgaagcattgcgaaagctgtccccacgcacccgactcgtcgccgtggacgccaagggcagcgccatcttcgacgaggcaggagcaccccatccccgctgtgtcccgggacacggtgcgtcagtgcgaccgccgctgtggcgcgcggggctcgccgaccaactggttctggtctccgacgcggactgcgtcgtgggatgccaggaggccctgcgcaccgaggctcttctcctcggcggatcctcgggagcaattctgacggccattcaccgagtgtctcccacgattcccgctggttccaccgtggtgacgatcctccccgacggcggcgagcgctacatcgacaccatctacagccgctcgtgggtcgactcacacatccccgggctgccctctctcgccgactggggggctcccaaccccgccaattcgtatgacctgaacagaagtgcctcatgaagctctacaccagagagaccgtcgaaactgcgcttgtcgggcgtcatggccaggttctcagtgccgtacagagtgcatacatgctgcattcgacgggagagacatcgctgccattctcaaccttcctccgcccggccgggtatccgaacgatcggatcatcgcacttcccgcccacatcggaggcgacttcgacatagccggtatcaagtggatctcatccttcccggaaaacctcgaccggggccagcaacgagcttcctccgtactcatcctcaatagtctggagacgggatacccgaccgccctgctggagtccagtcagatttcagcaacgcgaacggcagcatcagccgccctggccagcgccaccctccatggctccgaagaccatgtcagcacgattggcatcatcggctgcgggacaatcaatcttgcaacgatcgactacctcttccacgtgcacccccagatcaacgaggtcctctccttcgatctgaggcgggagcgggcccatgagttctcgcacctcgtcaaggcttcgcacccagaggcccgggtccgtgtcgccaaggagcccgacgagattctggccgcaagcaacaccatcgcgatcgccacgaccgactcgagtcattggttggaccttccgccgtggcacgggccggggcaccaagtcgtcctgcacacgtcgctgcgagacctgtcagtgccctcgatcctggcagcggccaacgtcgttgacgatcctgatcacgtctgccgtgaagcgacgtccttggatctggcaactcagcagaccggcaaccgggacttcatcacggggagaatcggagacctccttcttggcgcgccgctgtcctcaagtcctgactcccgtgtcattttctcacccttcgggctcggcatcctcgacctcgcagtcgcctccgtcgtcattgctgccgcctcctcttcagcagtcgagatcaatgggttcgaccccgggaaacacgccacaagcatgattgaggtgaatcgatgaccaccacacagatcaacgacaacacggccgttctgcgcgacgtattccccgccggctccgtcgcattcgtgagcggtgcctcacgcggaattggcgctgcctgcgcgacagcccttgcggccgcgggatgcaacctcgccatcacttatcgaaggaaggagaacgaggcggcacaaatcgccgaatccattgaagccatcgggcgccagtgcatcacaatgcagatggacgtaaccgatgagaaccaagtgaccagagccttccgcatcattcgccagcattacggacgcctggacgccgcggtcttgaactcgggaatcaccagtgacgggcatcttgcaacaatgagccgctccaagtggagctcggtgatcgacacgaatctgaccggaaccttcctctgcacgcgcgaggcgaccaaggccatgtactcgtccggtggctcgatcgtcatggtcgcgtccaccagtggagttgcagggcgaccgggccaggccaactacgcagccagcaagggcggaatcgttgccatgatgaagacgctggccccggaggttgcggcaaagaacgtccgggtgaatgcggtggcacccggcttcattcagaccgacatggtggcggccgttccaaaagcggcactcgcccaggcaatccaacacatccccatgggccgtcttggcctggcacaggaggttgcgtcagccgttaccttcctggcctccccgctcgccgcctacatcacagggaagaccctcactatcgatggcggaatgatcaacggctgaccccaggacccggacacccccagtaccgagaaaggaacaacaatgaccgagatcacccacactgccaacagcatccgaacccgcgccgaggaacgttccaacaaagcttggcgcctgaaggaggagatcatctccaagctcggtctcgagaccaagccagaatatgtctcggacaaccaaccgctcttcggacgtggccttgagatggattcccttgacactctcgaagtcgtcgtcgccgtcaacaatgagttcggagtctcggtcaacgacgacgacgtacaggcgttcggctcgatcaatgccatggtcgatttcatcgaggtgaacgagaagtgagttctcttgcgctcgaggcgccacccaaggacgcccgtaagaaattcgcctacgacagcgatgccatcaagacgatgctcccacatcgttggccgatgctcatgattgatcgcgcctacgacgtcgtcccagggaaatcgggcaaaggcatcaagtcggtcagcgtcaatgagccgttcttcgccggtcactaccctgaccattccatcatgcccggcgtcatgatcgtcgagtcgatggctcaactcgtggccgtcatctacgtagccgaggccattcagaacaatcccggcatgacgtcgcacgacgcacgttcaagcgttggttatctcggcgcgatccatcagatgaagttccgacgcctcgtcactccgggcgaccaactcaccctccacgcccagctcggcgagaaagtgggggctctgcgcgaggtttccgtgagagcactcaatggccgggatgtcgtcgcccagggggaactcgtcgtcaccgagcggtgacacccagccacacacgagaaggaagtcccatgatcgttcgcccctacaggccacgtgatgcggaagcgatcgtacatctctacaacagccattccgactcccccaatccagtgtcgggagggattgttgaggaggagttccagagggagctcgaagaacgtggttcgacagtgttcctagtggccgaggaggccggatccattgtcggcacattcgggatgttccgcacgaatggccgacacaccatggccgatgatgaagtcttcgccgacatgttctatgtcaccccgtcacatcgactctcgacagttccgggacagctaatcactgaagccatcagcgagtgcttcatccagggcatcaacgtgatccgcctcaccgtgaaccccgcgaacatctccgcgctcaaggtttacagaaaagtcggttgtgcctgtctcggggccaccgatgcaggcgaggacgggaacattgagctgtacaacttcatccctctggttcttagggcaaccatcaccaaactcgaccacgattgtattcgagccctggcggacatgacttcgttcgcctgcatcaccgagggacgtccacttgatctgtcccacgacttcatcgtggacgctggacggaagatcgtctcccacagcatccagatcgggcgttcaaccatccacgccatggtcgacacgggctcgaggaccattgtggaggccaccctcgacaaccgcgactgggatgctcctcgccagatcgtcgcccccaccccctgtcagaaccggcccgaggaacagcgaggcaaccctgtccggctggtgcacaagaagcttgaggtcaccttcaacgaaggagtcattgagatcagtacgactggccactggggcccggtcctcgcaatgtcctggccctcctccgtctcgcaccgcgctcacgggtggcgacagggccccgccaagtcgtatcgatgcgagcttctcgagaattgcctcgtcctggatgacgaaggaggagtgaaatgcaccatcagcctcaatgattgccaagtcgcgatccggatggatggtgccccaaaaacggaattgagaatgtaccagtggtgcagcctgcgccagggctatctgacggctgacaccggcatcacgagcttcaaccgggcatccagtgggctcggagtcgccgtccgggactcgtccgagattgtcgccgcgggccttcccgtcatccctgacacaccgatcacatggagtgagggtgacatcacggttcagctcgatccctgcggccgcgcctccctgatccactcgaccctggtggaccgaagaatccacttggacgagtctggctcggcaagtctcaccatgaccgtgtttggtgactcccagccccatcgtgccgacaccgtcgagctgcctcccctcgcggcaggcaccgacaggatcgtcctcaagccggctgccggaggcgtgaccacatggcgcttgggcgccaccaaggtgctcaagtcaccgtggccacacgcccgcgcgctcgggcccaatccgatctggcgagccggcctgtgggtcagtcacgagccggatcgccacgaccgtcgccaaggaatggggtggggtcccgatcatcgcagttggaccctgtcggaagacaccatgaccagtactgacgggacactctcctggcgcttcagcggctcccccgacaccggctggacggtcgacgtcacgacgagcaacacgcacggggagaccgtcgtctggctcaccccggactgcccggcgggcgagaggatccgcacgtctgatcatgccgtgacgaccatgcttgacatctcgaagccatggcagcgctggaccacccgatgcgcaattcctctcagacacgggaagtggttcctcatcgagcctgatcatgacctcactgattcccccgaaatcctcatgcgctctgttcacggggtcctgctcgtcggctgtgtcggacgagcccactccggatccgcttcctggcgctttgccatcacgtcagaactccccacctccaacccaagaagaaacgactacacctcagccgcctgaacccaaccagttggaacacccactacagaagaaatggagcaccaccatgtccatcactgagcagtacaagacccttcgcacctcggtcggcctccacacgcctaccggtcccctggtccgtatcaccggtgatgatcgtctcgagtttctcgacaccttcctgtcccgcgcctcggacttcgtggaccccgacaccactcgggagtgcctcgctctcaccgaggacggccttccgctgacgatcttcctccacatcgagcgcgaggaggagtcatggctccttccccgcaccgccatcgatgcggcgaccctcgccacgtacctcggcaacctcgagaccgatggtgacctgtcaatcgagattgctccagagggttggggagctgtcgctgtcgaggggccgctgtcgtggcagatcgccgaaaaccttctcgacttcgacgtggctggcctcgttcttcacgccgtcacggacgtcgtcgttcccggggcccccgagggatcgaaggcatggctcgcccgggtcggaaccactggggagtacggctacctgctcgtctccaacgttcccgacctcgcccgcacttatctcctcagccgcgccacggagctgggcggtcaggcagtcgacgccgatgctctcgcacgagtccaggccgaggccgggatgccctattacgcgatgggcgtgtgccacctcgatgtcgccgggggtgacctcgcctggctcgtggactggcagcgcatcggcgagttccaaggatccgagaatctgcccacacccgtccgagaccagcgccgactggccgccatcgccctgcccaccggcaaccgcccggaagctggtcagaccgtcgctgccggggatgaggagattggagtggtggtgtacgtcaccccgtccgccaatcccgatgaggaactcgcgttcgcacttctggatgctcctttctggactcccacccttccgttgaccgtcggtgcccacgacgggaccacggtcaccctgccccgcgtcgtggcagcctccagcctcaacaagctggggtgacagcgatgacgatcactgctgagaacgccaccacccgcagcgacattgcccggagcattgcggtgaccggcgtgggactggtcacggcacagggtgaccataccgacgagtgctggaccgaacttgtcgatggggtttgcggaatcaccatgaacgtcacgttcgatgactctggcaccacgattccgtgtgctggcgtggctcccattccgaactctgattcgatcgaccgctgttacctgctcggcgtccatgccatgcgtgaagctctcgagatgagtggcatcgacctggactccgtgggtcgtgatcgcatcggactcgtggtgggctcaagcctcggcgcgatgcccaccttggaggcggctcatcgccgggccattgagaccggcgtgctcgatgccggattggcggcagactcccagctcccctgcgtcgccgaccacctcgccgctgagttcgacatccgtggaccccgcgtcgtgacatcgaatgcgtgtgccgctggtgccgtggcgatcggctacgccgcagaactcctctggtccgacgatgtggacctggtcgtctgtggcggtgtcgatccactggcccagatctctgccaatgggttcacgtgcctgggagctctcgacaatctcccatgcagcccgatggccggttcctccggtctgactctgggcgagggagccgggttcatggtcctcgagagaacagatgcggcggctgccagaggccaggaggtgatggccgaaatcgccggctacggcacaagttgtgatggttaccaccagactgccccggacccgggtggcaatggcgcccgcagctcaatggaggccgccctgcgctcagctcatctcaagccgtccgacgtcagctacgtcaatctccacggcaccggtactccgaccaacgacgccgtcgagccgaaggcactccggtcattgttcaagtccgatgaccttccccctgtcagttcggtgaagggcgccatcggtcacactctcggcgctgctggcgccatcgaggccgtgtgctcgatcaaggccatccacgagggggtcctgccgccaaccgtcaacaaccgcgggcaggcttcccgaactggtctcgacatcgtgccggagtgcgcacgcaaggccgctcccgacgtggtcatctccaactccttcgccttcgggggcaacaacgcatcagtggtcatcaccgcacctcgaggaggcgttcactgtaccgccccggcgcagcttcgcgaggtcggaatctcaggaatggcagctctggcgggaaaggccgccaactcggaggagcttctttcggccctgtcagaagattgtccaatctggatggccgatgagaagacctgggaaggggatgctgtccaaaccggccatgtggacatcaagcgcctgtcccgcacaatcaacccgtccaaggttcgtcggatggaccccttgggaatcatctccagcgcggtggtgactgatctgtatgcccgacacgggaagctgagccgcaaggatgccgaaagcacgggaatcatcttcgcaaccggctacggtcctgtgacggcggtgacgcagttcaatgacgggatcatccgccacggttccgagggtgccaacgccctggtgttcccgaacaccgtggtcaacgcagccgcaggccacctcgcgatgctgaatcgctaccgtggttacacggccaccttggcatgcggtggaaccagttcactcatggcgctgcttctcgctgctcgcgtcgttggccgcggcgctgcggatcgcatcatggtcgttatcgctgacgagtttcccagcattgccgtccaggccgtcgcaaagcttcctggctaccgacacagggttgatggttccggagccgtgctctcggaaggcgcggtatgcgtcctggtggaggccgtcgaagtcgccgaagcacgcggtaccgcccccatggcgctgctacgcggcttcggatcccgtggagagtccgtgggagtcggtcacaccgcatccgatggacgggcttgggccaaggccatggccgctgcactgggccaggccggcctgactgcctccgacgtgtcgaccgtcgtggcggcatcaagcggacatcctcgcgtcgaccgagccgagcaggcggccaggcggatcgtcggactgtccgcaaccgctacgaccttcccaaaggcgattgtcggagaaacacacggatcggctgccgggatcgggctgttcggtgccctgtgcggttcgaggtcagccgcgcaccagaacatccttgtcaacgccttttcccacggcggtggttatgcctcgatggtggtggagtcactgtgaccacgacgcttctgccacgggttgcccagccgggaccgggcgtcagccatgtcgacaccgaccgtcccatcgagtgcatcatcacccaccacccccacatgccgcgtgatcgcggaggccacgccacctccgtgtcaggcaggtacttgctgcgccaagccgcagaactcatgctcggcacggatcctgcgcattgccccgtcgtcgacccttcgcggcgctggtactggcccggaatcaatcttcacggttctgtctcccatgtcccgggctggagcctgacgacgctgagcaccggcggccacatcggggcagacatccaggacttccgggagcgtcccggcgcaatggcattcatcggtgacctggtcaagctgtcgcgatcggcgtcactccgagaattcgcggagtgcgaggccgtcgtcaaggtgtccgaattgactaaggagacgttcgggcacgtgcgactgcccgaatggacacccggatggcgccacgttttcgaggactactgggtctggagtctcgagatgcacgggatgggagtcatcgcactcgcatccgatctcccccgagccattcgctggtggcggtgcgacgccgatgcccgtggccgtctccaggctctccgacccataagcagtcttggaccaggaaggccgtcatgagccggtactcacgtcgaatctcaggcatcgaacgcggctatctcaacgccgcaacccggggcccgcaccccaccatccacacgatgatcgacttcgagggccgcgtccccgccgactgttggcggcacgcatccacgattgcgtcggccgccaaccctggcatgacagtggtccggaggtcgggccgatggacatccgatccagcgggctgtccggttgtgttccacgactggaccgcggaccccaacgacgttgccgacttccacgctgacatggatctcgtgacgggaccatcgtccacgctccacgttttcgagggggcggaacgcacccgaatcaccttggcagcaagccatgccgtgaccgatgggcggggcatcgaacgatttctcgtcgacctgcttgcagcgttggacgagcgtgaacccattggaagccccgacaccctgaccgatgtcgatatcaaacgatccttggagaacagcatcaagccccgacgccacctggccgctgtgcccgccgatgtcctttctccactgggggggaggaagaaccaacgtatatgggcctccaggacgtggcacagtgccccgggagccatgagcggaagaatcgctgccgctgtggccgagatgatcgaccacgccgcaatgatcatcatcccggttgacatccggcggcacgtcccagaggtccgatccacagcaaacctaagtgcccaactgccagtgatcatcaccccgaaccagcgctggcaaagcatccatgggcatctgctcacggaccttgctcgccatcgagaccttgcgatcatcagtgaggatttccgccacaacaatccgttcgcatcgaccttggaggaaagccaggccatcggcctcgatggtgtctatccctgtgccgcaatcatctccgaccacgggaagctcgacctttcaaggttccagaccttggaactcaccccggtctcgatgcgaagcctcccgatgctcgttccctactccgcaatgttcatcagcagttgcaccgtcggcgagaccaccactgtcaccatcgctcatcgcgctgatgacgatcccgattccataaacaccttcttccaccacatcgaatcccagatgtccatctgagccacgtcgtccctggagagcaaacatgaccacccaagatgtcatcaccccgccgcgccccgtcacctcccatgccacggcgaccaggtccgaggctccaccgcgaagcgtcatcagagccatggccatctcgatggtcgcgaccctcatggtcatgctcgacacgaccgtcgtgaacgtgtccttgagcgcgaccaccgcccgcttcgggagcatgggcagcgtgcagtgggtcctcacaagttacctacttgcactgtgcgcgacgatgacggcctccgcctgggtcatcgaccgccttggtccacggctcaccttcatcgcctcaatgaccatgttcctcatcggctcggtgatgtgtgcactgagcgattcagtgtggcaactcgtcactggcaggaccatctccggtgccggagctgggatccttgttccgacagcatccgtcctgcttatccgtggcatcccacgcgaacaacttggcagggtgcaggcactgaatgggagtgtccagttgatcgctcccctgatcggcccgactgtgggcggtctcctcgttgacaggtgcgggggctggccggccatctactgggcgaacgtccccgtagctcttgttcttctgattgaggccgtccgcgtcgatccggacgaaccacacaccgctaagcgccgcctcgatgctctcggcctggtctgtggcagcaccgcgatcgtgctgacagtgcttggtgtctcactcttcggcaggacgtcgcgaaacaccaccttcctgcttacgatcggcgcgcttgcagtcctcgcatgggcgttcttcatcacccacatccgaagggctaccaaccctctgcttgacgtttccctgtatcagaaccctgtctattcatggtccagcttcaacgtagcggtgcttggtttcggtctctacgcccccatggtcgtcatgcccctctatctcgaggcgacgcgccacctcactgccgtccacactggtctggtgatgtcagtggccggcgtcggcgtcattatggccggaatcctgtgcacgaagatcatgggccggatcggtggaggcctcacgatgacagttggcataactctgagcatcatcgccactctgcccctggcccggctgacgaaccacacctcctacatactcctggcagtctgcttggccttgcgtggagcaggaatcagcctgacaatcgtcccagccatgacacgggccttcgagtccatcaagaggacggccatggcggacgcctctgcacagctcaacctgttgcagcgaatcggcgggacaattgcgacagcagtcatcatcgcagttatccaccacgaggccatgctcacccgcggactctcccccacagtgttctcgcacgccaacgtgtggatcctcaccgcgaccgccgtcacccttctgccggccttcgcgcttgcgaaggccgaaagacaacagcaggatctctgagcaccgaggagtactccctcgtagaccctcctctgatctaattgggttcgttccaagtgtgtatctcactccggggagccccgattgctgaaccacatcccgttcaccctggcgagtccctcgtggtacgacgtcccctgggcgcccggatctccgtatctcacaggagatatctcggtcctgccagcggactcgccaaggtggacgacgaccatccggggtccttggcaaatccacatgccacctcgtccgacccttccagaggtggggtggaaagtgcatgtgtctgccaagccatcggaattggaatcggttgcctcagtcgtagcactgtggtgcgtacgccacagcgtccccttcaaagtacttcgcacccgaggtctcgttcacgcgagtcaagtcaagtatgcggaccgaagtcagagcggcaaggtctgcacctgctaccccgacggcgagagccttgagcacttctgctccggtcttgccgagctgcttcagaacgtcgattcacctccggtgtccggcgagctgcgagtcggatcctcccctctgtggttgcgtcacgggagtttccgagaggcatgggcggtgtcatccacaggagtaccgttcccggtctacccgggaacaacacatcctgatcgtcgaggccccgcgcccgcagaatccgatcacgacacgccgtggatccggaggctccgtcggacgaatcgccccagcacggttcttcccatcgacgatgtcagactcctccaccaatcaaatgctggcggcgtgtatcaggcaacatggagagacggcacatcggtagtcgtcaaggaggcccggcacctgtccggacttgatgcggcgggtgtcgacgcccgagtgcggctgcgtcacgagtacgaggccctgagaagactggacccctatcgggccgctccccatcccattgatctcattgagaccgaggacggctcgttcctgatcatggaattccttgacggaatgacagtccaccaggagatgtcgaggttccatcctctgattggtaggcgacctcatcggctatcgatgaccgatttttcacgctggtgccgagaggtcgaagatcgcttgaggaatgtcacgagggtcatggccgggtgcggaatcgttcacggggatcttcatcccgcgaatctgatacatgtcggccatgaggttttggttactgactttgaatcctgctcaatcgacggggtcgccgtctcgtcagggatcgccgctccctggttccagtcggacgacacgattcccgatccggcgacgactgacgatctccacactcttctcgtggatccgacttgcggccccgcgcttgtcctccatccaaatcttcgcgcgctcatcagccaggccgcagtcgaggacatgatgggaaatccgactggtttaccacatgcctggaacctcgaggacgtgacaagcgaactcgccaaggggatccgggcatcagccactcccgcacgagccgaccgcctctttccctcagacccctacctgttcgggcatccaggttcagaattcggcctgatgcatggcgccgccggaatcatggctgctcttgccgtgactgggtacggtgttgacgcgaatcacgtgacctggatgaaggaccgcttggccacccgcccgaccctgctgccggggttggccaacggaatcgagggaattgccctgggtctctccctgtgcggtcagaacgacatggctgcatccctgctccaccagtccggaattctcacgatcacaacgaacggatcgactgacctcaccctcggtactggtatggcgggccgagcgtgcgcgctgcagtccctctcacaacgactgtcatcgaaatctctcgcccacgctgcatataccctctgggaacaactcgccgtggctgtgcggaacactgatgtggccttgccgaacggcctgttctccggttgggaggggatcgggctctccctgcttgcctctcccctgccggatcgtcatgatctcgcccgccactcactccgactggccctggccacgacaacgattgttgacggtgcgctcttctcaggcgagggacagatccgatggccatatctggggcgtggtcccgcggcatgtggcccgctcgccgccaggcttgatgatgaccagacggccaaggccgtggcacagacctgtcgttgtcccctgactgagtcatccggtctccacaatggccgcgcaggtctcctactcgtcctccgccagctcgtgggagaccaagacgacgccgttcgccgccacctcatgagactgtcgtggtcgatggaccgtcgcgaggaaggcacattgctgctgggtgatcatggcctgcgtttctcatccgatctcgcgacggggtcagccggcgccctcctcgccctgagcagggacccatggcggaacatgacacgaatgctcggaatatgcgatgacacctgtcatggcccactagtgacagtttgatctagcgccgatagttcacaactgaaagactccaaacatcgaggaaaacatgctgagccaaaacgccttggcaggcgtggctcgtttcaccacgatgaacaccaggagacagaatgtccgttgaggccatgcaatccatcgagatggacgaggaaaacagcgccagccagacagtttgcgcttgttacagcttcttctcgtggtcaggatgctgcgtagtctcccaagcggtggaagcatcttgatcgtgtgagacgccgtcgactaccctgtcccccgtggtacgcacacgccccgtcctggacagtcccggaagaccgctcatcgcctccggagtcgtcctggcggtcctgctcatcatcgcggtgatgacgatggtgcttcagcgcgaccccactctcacccccggacgccgcattctcggtatcgtcctgtccacggtccaggccgtcggattcatgtggctgcagacccgcatggttcgtcacggcaagggttcgcgcaacatgcgtgcgacccttggaagggtcggtttctgggccacgtggggactcgtcgcagtgggagtcgtcaatctgtggctgaccaactcgtggaccctcttcggggcctccgtcgccacgcccctccttctcctgccaggggtgtggagtgtggtggccaccctcgtgaccctgatcgtcggtttctccgacctcgtggtcacccacacctcgccactgacctcagccacggtcgtgctggtgaccatcgcggtgtcggtgaacctctacgcattcacgaagctgtcgacggcactcgttgaactccgctcctcccaggaggagatcgcccggctgcgcgtggacgccgagcgtcaccggatatcgcgggacctccacgacatcatcggtcgcaccctggtcgccacgtcgatgcgccagcaggcggccctccacctcgtcgaccgcgacccgcaacgggccaaggaacagctcgacgccgcccatgacgcaatcaccgaggggcagcaccagttgcgttccatcatccaggccgagatgagcaccagcctccccgacgagatcagcgacgccacattcctgtgcgaccgactccacatcgacttccgcatggatgaccgcggcagaccgcacaaacccttcgactcggcggcggcggcggccctgcgcgagggaatcacgaacatgctcaagcacagcgcggcgggctactgccacgtcgccatctccccggacctcctgaccgtcaccaacgacggttgtccgcaatcacctcgcccctccaccacaccgggcaccggaatcgaccatctccggtcccagatcgaggcgctcggtgggtcggtgacgacgtcgcggccctcgcggggcaccttccggctccgctgctccttcccgacccggggggcgtccacgaccacacccgcaaccgaaggaggacgatgacgacgagaatcctcctcgccgaggacatcaaactggtggcagaggccttcgaggcactgctctcggtggaaccggagttcgaggtcgtcgcacgggtggcacgcggcgacgacctggtcacatccgccacccgcctgttccccgacgtgatcctggccgacatcgacatgcccgggatgaccggcatcgaggccacccgaatgcttcgcgacaagggataccgcggcagaatcatcctgctcaccgccctgccgggaagcgggcacctgcacgccgcgatggctgccggagccgacgggtacctgctcaagtcgatcaccgcgccctccctcatcaacgccatccgggcggtgtgcaacggccagtcggccatcgacccgaacgtcgccgcggtcgccatgcgcaagggaccctcgcccctcaacgaccgggaaaccgagattctgcgcctagtcgccgacggttcctccaccgcgcagatcgcctcgcggctgtacctcagcaagggcaccgtcaggaactacctgtcgacggcgatgtcgaagctcgacgccgactcacgcacagcggcggtcacgcgggcacgcgaggagggctggctgtagcaggcgacccgctcagcccaccgcccctcagcccaccgcccctcagcccgccgactcctgacgcacggcctcctcgaccgcccggctgagcagggacccggccctgaccatcgacgtctccgggtccggctcgaggtcggacaacgcgatgatccggtcgaacgcggaccgtttctcctcgggcaggtcacagcgtccgcacaccgcccagacgggcaccccggcgtcccgggcgatcttgcggatggtgtcgagaagcttgccgagcagggtctgctggtccagccgcccctcccccgtgacgacgagactggaggcggagatccgcgacaccgcgcgggaccatcccaggacgaccgccgcgcccgggcggtacctggtccccaggcacatcagcgcccagccgacccggctgggcggctgcgaaccccctggccaccgcccggcaggcctttcccgaactcagcgaccccttgaaggagtcgacggcaacgatgaccggcgcattcggatcaggacgcatgggatcagcatgtcacgtcgatacggagcagtcgcgccgcctacccctagactcgggggcatggtcaaccgagtctacctgtccctgagcgttctcgccctcgtgctgtgggtggtcgcctaccgtcacatgccgggctgggccgcgggcatcaccctggtgggcatcgtcgtgctgtcgctgtggtgcgagtggtcgcgggtgcgcaccctggccaggatcggcaagtcccgccagcagggcccccgctcctcccgaggacgcaacctgtcgtgagcaatacgattcccgcagccctccaccccggccctgacgaggcc

SEQ ID NO: 434 - DNA, 26636 bp, Propionibacterium acnes
ccttgtggacaccacgtcatccacatgacttgtgtcacatgattcccggaccatcatcaagcagatgctcacccaactgtaatgatttctgttctgaatctggacatgctctgacctgcattcaatgatcaattccgtgcgatattccacaacgcgcggagaggtcgcagacaatgacaacagaaagcatccccacgcggctgctcgtgtggcacgagcagaccgatccgaccaagctcctcaggatcaccgacgcgatcaggaggggggatccccttccccccatcgaggccatggcgatcggccacaaattcctcgtcctcgacggtgcgcaccgggcccaagcccaccagtactgccatcgatctgagatccgagcccgcctccacaacctccccctcagcgcggaagtaccaggctggagccactccataccccgcgatgcagcagcgaaactggctcacctactcctccccgtggacgctctcggtcaggcggaacatcgtcctgcacggggtgcgccgtcaggtggggaccgcttcacaacgaccgcgcgacatctttctcgcctgccaccggatcgcgcgagttgcctacgcgcatggaatcagacctctcggcccggagttctccaacgctccgacgatcgacgccgccaccatgacctggcccccgccgaacgtgggcacgttgtgggccatcgccagcagtctcggacccctgcccgcaactgtgacccggttcgccccgatcctccggcacgacgccatcggggattccgcgatgacacccgtcacctccgccgcgtgacgacccgcgccaattccgccccaccactggatgaggggcagccgcgtggacgatgctcctgttcaggcagggactccatacgagaccaataggaaaatcatgatcaaaaacacaagccctctgaccgtgaaaaatgtctcgaaaacattccgtggctccagcggagaagccatcaaggccgtgcaagacgtgtcattcaccgttgagcgtggtgaggttgtggcattcctcggcccgaacggcgccgggaagtccaccaccatcgacatggctctcggcctcacccgccccgacagcggccagatcgaggtcttcggtactgacccgctcagcgcggcccggtcgggacgctgcaccgcgatgacacagaccggcgggttgctgcccgacctcacgattgggcagaccatggagatcatctcctcgctctatcgtggctcccacatgaatgcctgcatggagcgagcaaggatcacgcatctggccgatcggcaggtgtcgatgtgctcgggaggcgagcgccaacgacttcgcttcgcactggctctgctgcccgatcctgacttcctcatcctcgacgagcccactgcggggatggatgtggaggcgcgccgggacttctgggcagagatccacgaggacacgcgtcgtggtcggacaattctgttcgcaacgcactacctcgacgaggtggacgagttcgccgatcgggtcatcctcatcaaggagggccgcgtcatcgccgacgacacctccgacgcgatccgcaccatgtcggggggttgcaccgttacggcgaccattcccgacttctccctggcacgactgaatctgccgggcacccaactcatcaagcagggcggcgcacgcgttgatctgcaccatcccgattccgatgccctcgcagcgcgagtcatccagctcggcggcaccgacctgcgcgtggtcccccgcagcctcgacgacgccttcctcgctctcacctcaaccaccaaggagtcctgacatgaccgcccaagcgcttcccgcagtcgccactcccaaggcccgccaccgatccgccatctcgctgaagtacttgtggtgcgagatgcgtcgccccttccggcgttcgacgatgctgttcaacctcgccctccccgcagttctgtacctggccctgttccgcaccgtccacaccgccgagctgccggacgggaacttcgcgatgtggatgatgatcggcatcgctgtctacggagcggccactgcgagcaccagctacgcagcctccatctccgtcgacgaggccaacgggtggacccgcaccatccgcctgacgccgttgtcgtcggtcgggtacgtgctggtgaaggtcctctgcgccatggccatcgccctggccccgaccctgctcatcggtctcatcgggctgttgaccggagctcacggcacgctgcgggtctgggtaatcggactgggggcggcttggctcagctcagcaatcttctccgccttcggcctggctctcggactgtccctgcgtcccgaggtcgtcatgcacgtccccggcctggtcatcaccggtctggcgttcctgggcaacgtcttcgtccccctcagcgggacgatgctcaccattggccgctggagccccgcctacggcatcaccgcgctggctcgttacccgctcaccaacggcatcgacatcgggggcggccacgactccctgacggctgccctcatcggcaccttctgctggttcgccggattcgtgttctgggcctcccgtcgatttaccaagagcacgggtcgtcagtgacagattcggccgatctccggaaggagcagtgttatgaccaagcccctcattgcagtggtcaccgcgggccaaggagcgcagaagcctcgcctgctcacgccatggctcaaggtccccggcgtcacggagaagcttgctgcatggtccgctcaggccgatgtggacctcgtcgagctcggtaccagggcgaatgcagaaaccttggcagcgaccgagaatgcgcagccactactggtctgtctcggagtcctcgtctcggatctcctgaccgaccagaacattgtgctcgcaggacactccgtgggcgagctgacagcagcgtgtctcgccggggtagttgatcccgggacggccgtcactcttgcacgacggcgtggactggccatggcgcgggcctgcgctctccacccgaccaccatggcggccatcattggtgacaatccggatgacgtcctccggcggctctcggaactgggactcacggctgccaacatcaacggaggcggacagattgttgcggccggctccaccgacgcgatcgcggaactggtggcgacccctcccaacgggaccgcagtcaagccgttgcgagttgctggcgcctttcacaccaagtacatgacacctgcgcaggacgctttcgcccaagctgctcaggacgtcaccttctccgacccgcagcacccgatcatctccaacctcgacgggcaggagatccggtccggcaatgacctgcgtgaacggctgattgcccaggtgaccgcgccagttcgatgggatctctgcatccagcagatcgcggatcgtcagccggaactcgccctatcggcccctccggggaaggtgcaggcgtcgctcttgtctcggcagatcccggacctcgcgacggtctgcatcaccacaccacgggaggcagcccaggctgcacagcggatcgaccagtccgtatccgtccttcagggggcatgatgctcatccccgagtacttcctcacagcctgttcggaccatgctgagcgcctggcgatcatcacccacaatgacgttgtgacgtgggccgaactggcgactcgcgtcgacggttttcggcgctggctgcgggaccatggcgtgcaccgccaggacagggtcgttctccagacgccaagcaccgtaggcacggtagccctcatgtgggcctgcctgctcgacggcgtgacgatggtcccggtgcaccaggacctcactgcctcccaggtgcagcaagtcatcgacgactgccgtccagctctggtgtgtggcagcccggacctcgtccaactcctcaactcccccggaatgaagacaagcacacctccaacgcggccggagtcaacgagtattctgccgtccttgtcccgggtcagccccgatgaccttgcgatgctcatctatacgtccggcacgacgggtctcccgaaggggatcatgtgtccccaccggcaggtcgccaccgccgcacggatcgtccatgactgtctcgggtaccgcacggacgacgtcattctctgtcgcctgccgttgtccttcgactacgggctctatcagattctgatgtctgccatctccggtagcgcggttgtcctgcgggacggaggcgcgcaggaccgcaacctggtgcgcgacatcgcccgtcacggcgtcactgtcgttccagtcgtgccgtccatggcgtcaatgctcatcaccctgcagcgtcgtgatcagttgccgaccatcgtcagactgttcacgaataccggggcgcgtctggcacccgagaccgcgaaccagttgctcgcaagcttccccggctcccgctatgcgtcgatgtatggcatgacggagtgcaagcgcatctccatccttccggtggaggagtacgagacgcatccggacagcgtgggaagagctctgcccagcactcacgtcgagatcgttgacgctcagggagttccggttccggcgggcgagcacggggagatcacggtgtccggcccgaccgtgatgaacggctactggcaggtgccgaacagtcccagtggacgattccgacccagcggccacggcctcactctgttcaccggtgatcgcggctggatggatgaggagggacgtctctacctcctcgggcgcgacgacgagatcgtcaagcatcacggcatccgaatcagcctgcaggagatcgagatagccgccgaagccgcgccgggcgtcgacgcagtcatcgctctcaagccggcctccgactcggcccccattgaaatcgcctactgcggcagcacgagtcccgagaacctggcccgccatctcgaaaccgtcctggaccgggcgcgacgaccccaattcatccaccaactccagcagatccccctgacccgtaacgggaaaccaaaccggtcagcagccgccgaggccatccgctcaagggcgtgacggcgaaggccaacacccacagacgaaaggaaaccaccatgacccaggccgagttcaaccagttcatcgagtccacctgctccgcgacgatcgtggatcccgaccgtcctttggtcgatcagggcatcgactccctcggaatgctcaccctcatggtcgctatcgaggacagcctcggcatcgaactggatcccgagtccctcgccgacggtaggggttccacgccctccggtcttctgtcccttgtcgagcagctgaaagcgacggtgtgacgacatgacgacgatggttccttgccgccgtgtggagatgccgcaactgttcgaccacatccccggaagcatctctctctcaggagggctgcccgatctgagcgtgctcccgagcaatcagatcgccgaactgacgtcccggatcatgcgtctcggctcaagaatcctcctgcaatactccaccccttcggtctcgtcctccttggtgccggccatcctggacctggcggaacgaacatgcatgtcaccggatccgcggaatctgatcccgaccgcgggttcccaactgggcctggccatggtgatcaatgcctttgacggcgatgagatcatctgtgactgcgccacctatcccggggcgctggccgccttcgcctctgccggcgtggaaacaacgggggtggccagtgacgaggaggggctcaacccagacgcgctcgctcacgccgtcgcagagggtcgggccaatggccgccgcatcgcagccgtctacaccacgcccaccttccagaatcccaccggctccgtacagtccgagaaccgccgtgcggccctgctcaaggtgtgtgctgacaatgacctcctcctcatcgaggacgatccgtacggcatgctgtccttcgacgggcagacgtggccagctctgaagtccatggacccacagcgcgtcatctacctgggcaccttctcgaaggtgttcgcaccgggcgtccgttccggctggatcgatccgcccgccaatcttgtcgagaaactccgcgctgtgtgcgagatcatgacactctcgccatcagccctcaaccaagcgatcatcggcgagtaccaccgtcgtcacggatgggacgaactgttggagggctatcgcgcctcctaccgcgaccgagcccgtctcctcatcggggctctcgaggctgaactggcaagaacgaattgcactggcacgtggacctggcgtgaaccacggggcggcttctacctgtggttggagaacgtcgccagcaccagcggtatcgacgttgcgcgtcgcgccgccgacaacggagtggccgtggtgcccgggaaacacttcgacgcagccggacacgattcgccgagcctgcgggtgtcgttcagcaattcacgcccggctgatctggtcgaaggagctcgtcgtctcgcccgtgcactggtgggagaggacgttcagaaatgactctcgcgacacgcaccgccaccgacaccctgcagcagaccttgccctggggcacccacgaacgtctcgtcttcgggcgggcgctcctgcgcagcaccggcttcccagccgaaggcttggccctgctcgactccgacgacatcctccccctcctcgactcctttcttgccggggacatcgacagaactcacttcgagaaggaatacaccagtcgcgaggagtccggcgcaagggcgctcatcaacgtcttgaaggacgatgcagtatcgcgcgccatcgcatggcagaaccccaccgcgtggaggtccttcgaatccctgtcgtccacgagcggaatcaatgcttcgactcggcgcaaggtacgccaactcgccctctactggcaacgttactgttccaaggctgagaccattggatacttcggcccgttcgcctgggccgaagtcgacccggaggcctctgcggtcgaattcatctcctccgaccatctgatcgaccgttcccacgtcgcaatggaggcgtgggcggtcattgagatcgggaaagccctggcatcacgggccgaccttcagtggtggatgccaccaatcctgtcccccgccgtcgacctcaacatggagagaggcaccgtgacggtggctggacaccagccacgacgggtccgggaggacgaggcacgagttctcttcctgaccgacggcacccgtcccgccgcccagatcgccaagagcctcgacatggagcccgagcggttgcgcaggatcctcgtggcccatgaacgtcgtcacaccgtgatctgggacgccaacatccctgtctcagtgcacgcgtgggacatcctgcacgaacgcattgcccagatcggagacgctgggctgcgagatgaggccactgctgttctcacgaggttcgacgagcttctggaggtcatccgcaacattcccgacgcccggtccctgacggaggcgacggaatccctgtcccgtcttttcgaaaccgtgacaggaacctcttcgaacagacgtgcgggccaggcatatgcagcccgcagcctgtgctacctggactgcacccgcgccggaaccgccaaggttgggacccggcttctcgaagccctcgacgcccccctcaacctcgtcctacaatccgctgactggttcgcggcgaccttggcaaaggaatacaccaccgaaatcacggacctcgcaaatcgaaagcagcgggcctcccaccagccactgaccatggctgatgtctggccgtccacgatgtcgctgttctggggggactcaccgtccccactgcagcgagccgtgaccgaactgtcacggcggtggagcagagtcctcgaggggctgcagccagtcgacggtcgcatcgacacgacatcgtccgctctctcgggcgccgtggacgagcagttccccgtgtgcaccccgattccagaactgtcagtgcacagcccggacctccaggtcatcacctcgagcactagcaacatcgcctccggacgagtcactgcagtcatgggtgagctacatgcctgtctgagcagtctcgacatgccgttgctcgagtggtcgctgccccatggttccattcgcgatcgcatcaacaccgcgctcaacctgcgacgtctggttcccttgttccccgagacatggaggcgcaacaccggccgcatggttccagcgacggtcggagtgggggatcgcgcaatcgggttcactcggacggccgatcaagaccgtgcgaacacatggtcgatgtcggcactgctgttcgagcagaccgaggacggactcatgatccgtgatcccgatggcaggctctggaccatcgcacaagcgtggagcgtgcccatctccatggtcgccgccgatgcgttcaagatcgggctgcccggctcaccagcccctcggctcaccattgacaatctcgtcgtgttccgtcgtacctggaggtttcccgctggctccatcgacatcatgcacggttcagccgccgagaaacacgctcggctgagggagtggcaggtcacgaatcaccttcctgaccacctcttcgtcaagttcccctccgaacccaagccgatctacttctccttcgagtcccccgccatggccacggtcttcacgcgatcactgcagcgcgacgcccgagagaatccagacagtctcgtgacgatgtccgaagcactgcccgagcctcaatcctcatggctgcacgacacccggagccaccactacgtccacgaattccggctgcaactgaccaaggagcgacatgacgaccacagttgagacacatcccgaaacacgtggcacaaccgcgacatccatctccaatctgatcggtcacacccctctcgtaagaatggaccatctgttcgacggcctccccttcgaggtgtacggcaagctcgagaagctcaatcctggcggaagcatcaaggatcgagcagcacaatccatgatcgaacgggcaattcgacggggtgagatcgtcccgggccgtacgaccgtcatcgagtccagttcgggaaatctcggcatcgccgtggcgatgctgtgccaggagcacggcctgaatttcatctgcgtaaccgatgccaaggccacgccaacgaacattcgactcatcgaagcgttcggggccactgttgaggtgatcgaagaacctcatcccgagagtggcgaattcctccccatgaggctcaagagggtaagagaactgctgtcagagattccagatgcatggtggccgaatcagtacgggaaccccgacaatccggcggctcacgagcggactgtccgcgagatcatcgaggcaatcccgcgggttgacacgattgtctgcgcgaccggctcgtgcggaacccttcgcggctgccacgaagcattgcgaaagctgtccccacgcacccgactcgtcgccgtggacgccaagggcagcgccatcttcgacgaggcaggagcaccccatccccgctgtgtcccgggacacggtgcgtcagtgcgaccgccgctgtggcgcgcggggctcgccgaccaactggttctggtctccgacgcggactgcgtcgtgggatgccaggaggccctgcgcaccgaggctcttctcctcggcggatcctcgggagcaattctgacggccattcaccgagtgtctcccacgattcccgctggttccaccgtggtgacgatcctccccgacggcggcgagcgctacatcgacaccatctacagccgctcgtgggtcgactcacacatccccgggctgccctctctcgccgactggggggctcccaaccccgccaattcgtatgacctgaacagaagtgcctcatgaagctctacaccagagagaccgtcgaaactgcgcttgtcgggcgtcatggccaggttctcagtgccgtacagagtgcatacatgctgcattcgacgggagagacatcgctgccattctcaaccttcctccgcccggccgggtatccgaacgatcggatcatcgcacttcccgcccacatcggaggcgacttcgacatagccggtatcaagtggatctcatccttcccggaaaacctcgaccggggccagcaacgagcttcctccgtactcatcctcaatagtctggagacgggatacccgaccgccctgctggagtccagtcagatttcagcaacgcgaacggcagcatcagccgccctggccagcgccaccctccatggctccgaagaccatgtcagcacgattggcatcatcggctgcgggacaatcaatcttgcaacgatcgactacctcttccacgtgcacccccagatcaacgaggtcctctccttcgatctgaggcgggagcgggcccatgagttctcgcacctcgtcaaggcttcgcacccagaggcccgggtccgtgtcgccaaggagcccgacgagattctggccgcaagcaacaccatcgcgatcgccacgaccgactcgagtcattggttggaccttccgccgtggcacgggccggggcaccaagtcgtcctgcacacgtcgctgcgagacctgtcagtgccctcgatcctggcagcggccaacgtcgttgacgatcctgatcacgtctgccgtgaagcgacgtccttggatctggcaactcagcagaccggcaaccgggacttcatcacggggagaatcggagacctccttcttggcgcgccgctgtcctcaagtcctgactcccgtgtcattttctcacccttcgggctcggcatcctcgacctcgcagtcgcctccgtcgtcattgctgccgcctcctcttcagcagtcgagatcaatgggttcgaccccgggaaacacgccacaagcatgattgaggtgaatcgatgaccaccacacagatcaacgacaacacggccgttctgcgcgacgtattccccgccggctccgtcgcattcgtgagcggtgcctcacgcggaattggcgctgcctgcgcgacagcccttgcggccgcgggatgcaacctcgccatcacttatcgaaggaaggagaacgaggcggcacaaatcgccgaatccattgaagccatcgggcgccagtgcatcacaatgcagatggacgtaaccgatgagaaccaagtgaccagagccttccgcatcattcgccagcattacggacgcctggacgccgcggtcttgaactcgggaatcaccagtgacgggcatcttgcaacaatgagccgctccaagtggagctcggtgatcgacacgaatctgaccggaaccttcctctgcacgcgcgaggcgaccaaggccatgtactcgtccggtggctcgatcgtcatggtcgcgtccaccagtggagttgcagggcgaccgggccaggccaactacgcagccagcaagggcggaatcgttgccatgatgaagacgctggccccggaggttgcggcaaagaacgtccgggtgaatgcggtggcacccggcttcattcagaccgacatggtggcggccgttccaaaagcggcactcgcccaggcaatccaacacatccccatgggccgtcttggcctggcacaggaggttgcgtcagccgttaccttcctggcctccccgctcgccgcctacatcacagggaagaccctcactatcgatggcggaatgatcaacggctgaccccaggacccggacacccccagtaccgagaaaggaacaacaatgaccgagatcacccacactgccaacagcatccgaacccgcgccgaggaacgttccaacaaagcttggcgcctgaaggaggagatcatctccaagctcggtctcgagaccaagccagaatatgtctcggacaaccaaccgctcttcggacgtggccttgagatggattcccttgacactctcgaagtcgtcgtcgccgtcaacaatgagttcggagtctcggtcaacgacgacgacgtacaggcgttcggctcgatcaatgccatggtcgatttcatcgaggtgaacgagaagtgagttctcttgcgctcgaggcgccacccaaggacgcccgtaagaaattcgcctacgacagcgatgccatcaagacgatgctcccacatcgttggccgatgctcatgattgatcgcgcctacgacgtcgtcccagggaaatcgggcaaaggcatcaagtcggtcagcgtcaatgagccgttcttcgccggtcactaccctgaccattccatcatgcccggcgtcatgatcgtcgagtcgatggctcaactcgtggccgtcatctacgtagccgaggccattcagaacaatcccggcatgacgtcgcacgacgcacgttcaagcgttggttatctcggcgcgatccatcagatgaagttccgacgcctcgtcactccgggcgaccaactcaccctccacgcccagctcggcgagaaagtgggggctctgcgcgaggtttccgtgagagcactcaatggccgggatgtcgtcgcccagggggaactcgtcgtcaccgagcggtgacacccagccacacacgagaaggaagtcccatgatcgttcgcccctacaggccacgtgatgcggaagcgatcgtacatctctacaacagccattccgactcccccaatccagtgtcgggagggattgttgaggaggagttccagagggagctcgaagaacgtggttcgacagtgttcctagtggccgaggaggccggatccattgtcggcacattcgggatgttccgcacgaatggccgacacaccatggccgatgatgaagtcttcgccgacatgttctatgtcaccccgtcacatcgactctcgacagttccgggacagctaatcactgaagccatcagcgagtgcttcatccagggcatcaacgtgatccgcctcaccgtgaaccccgcgaacatctccgcgctcaaggtttacagaaaagtcggttgtgcctgtctcggggccaccgatgcaggcgaggacgggaacattgagctgtacaacttcatccctctggttcttagggcaaccatcaccaaactcgaccacgattgtattcgagccctggcggacatgacttcgttcgcctgcatcaccgagggacgtccacttgatctgtcccacgacttcatcgtggacgctggacggaagatcgtctcccacagcatccagatcgggcgttcaaccatccacgccatggtcgacacgggctcgaggaccattgtggaggccaccctcgacaaccgcgactgggatgctcctcgccagatcgtcgcccccaccccctgtcagaaccggcccgaggaacagcgaggcaaccctgtccggctggtgcacaagaagcttgaggtcaccttcaacgaaggagtcattgagatcagtacgactggccactggggcccggtcctcgcaatgtcctggccctcctccgtctcgcaccgcgctcacgggtggcgacagggccccgccaagtcgtatcgatgcgagcttctcgagaattgcctcgtcctggatgacgaaggaggagtgaaatgcaccatcagcctcaatgattgccaagtcgcgatccggatggatggtgccccaaaaacggaattgagaatgtaccagtggtgcagcctgcgccagggctatctgacggctgacaccggcatcacgagcttcaaccgggcatccagtgggctcggagtcgccgtccgggactcgtccgagattgtcgccgcgggccttcccgtcatccctgacacaccgatcacatggagtgagggtgacatcacggttcagctcgatccctgcggccgcgcctccctgatccactcgaccctggtggaccgaagaatccacttggacgagtctggctcggcaagtctcaccatgaccgtgtttggtgactcccagccccatcgtgccgacaccgtcgagctgcctcccctcgcggcaggcaccgacaggatcgtcctcaagccggctgccggaggcgtgaccacatggcgcttgggcgccaccaaggtgctcaagtcaccgtggccacacgcccgcgcgctcgggcccaatccgatctggcgagccggcctgtgggtcagtcacgagccggatcgccacgaccgtcgccaaggaatggggtggggtcccgatcatcgcagttggaccctgtcggaagacaccatgaccagtactgacgggacactctcctggcgcttcagcggctcccccgacaccggctggacggtcgacgtcacgacgagcaacacgcacggggagaccgtcgtctggctcaccccggactgcccggcgggcgagaggatccgcacgtctgatcatgccgtgacgaccatgcttgacatctcgaagccatggcagcgctggaccacccgatgcgcaattcctctcagacacgggaagtggttcctcatcgagcctgatcatgacctcactgattcccccgaaatcctcatgcgctctgttcacggggtcctgctcgtcggctgtgtcggacgagcccactccggatccgcttcctggcgctttgccatcacgtcagaactccccacctccaacccaagaagaaacgactacacctcagccgcctgaacccaaccagttggaacacccactacagaagaaatggagcaccaccatgtccatcactgagcagtacaagacccttcgcacctcggtcggcctccacacgcctaccggtcccctggtccgtatcaccggtgatgatcgtctcgagtttctcgacaccttcctgtcccgcgcctcggacttcgtggaccccgacaccactcgggagtgcctcgctctcaccgaggacggccttccgctgacgatcttcctccacatcgagcgcgaggaggagtcatggctccttccccgcaccgccatcgatgcggcgaccctcgccacgtacctcggcaacctcgagaccgatggtgacctgtcaatcgagattgctccagagggttggggagctgtcgctgtcgaggggccgctgtcgtggcagatcgccgaaaaccttctcgacttcgacgtggctggcctcgttcttcacgccgtcacggacgtcgtcgttcccggggcccccgagggatcgaaggcatggctcgcccgggtcggaaccactggggagtacggctacctgctcgtctccaacgttcccgacctcgcccgcacttatctcctcagccgcgccacggagctgggcggtcaggcagtcgacgccgatgctctcgcacgagtccaggccgaggccgggatgccctattacgcgatgggcgtgtgccacctcgatgtcgccgggggtgacctcgcctggctcgtggactggcagcgcatcggcgagttccaaggatccgagaatctgcccacacccgtccgagaccagcgccgactggccgccatcgccctgcccaccggcaaccgcccggaagctggtcagaccgtcgctgccggggatgaggagattggagtggtggtgtacgtcaccccgtccgccaatcccgatgaggaactcgcgttcgcacttctggatgctcctttctggactcccacccttccgttgaccgtcggtgcccacgacgggaccacggtcaccctgccccgcgtcgtggcagcctccagcctcaacaagctggggtgacagcgatgacgatcactgctgagaacgccaccacccgcagcgacattgcccggagcattgcggtgaccggcgtgggactggtcacggcacagggtgaccataccgacgagtgctggaccgaacttgtcgatggggtttgcggaatcaccatgaacgtcacgttcgatgactctggcaccacgattccgtgtgctggcgtggctcccattccgaactctgattcgatcgaccgctgttacctgctcggcgtccatgccatgcgtgaagctctcgagatgagtggcatcgacctggactccgtgggtcgtgatcgcatcggactcgtggtgggctcaagcctcggcgcgatgcccaccttggaggcggctcatcgccgggccattgagaccggcgtgctcgatgccggattggcggcagactcccagctcccctgcgtcgccgaccacctcgccgctgagttcgacatccgtggaccccgcgtcgtgacatcgaatgcgtgtgccgctggtgccgtggcgatcggctacgccgcagaactcctctggtccgacgatgtggacctggtcgtctgtggcggtgtcgatccactggcccagatctctgccaatgggttcacgtgcctgggagctctcgacaatctcccatgcagcccgatggccggttcctccggtctgactctgggcgagggagccgggttcatggtcctcgagagaacagatgcggcggctgccagaggccaggaggtgatggccgaaatcgccggctacggcacaagttgtgatggttaccaccagactgccccggacccgggtggcaatggcgcccgcagctcaatggaggccgccctgcgctcagctcatctcaagccgtccgacgtcagctacgtcaatctccacggcaccggtactccgaccaacgacgccgtcgagccgaaggcactccggtcattgttcaagtccgatgaccttccccctgtcagttcggtgaagggcgccatcggtcacactctcggcgctgctggcgccatcgaggccgtgtgctcgatcaaggccatccacgagggggtcctgccgccaaccgtcaacaaccgcgggcaggcttcccgaactggtctcgacatcgtgccggagtgcgcacgcaaggccgctcccgacgtggtcatctccaactccttcgccttcgggggcaacaacgcatcagtggtcatcaccgcacctcgaggaggcgttcactgtaccgccccggcgcagcttcgcgaggtcggaatctcaggaatggcagctctggcgggaaaggccgccaactcggaggagcttctttcggccctgtcagaagattgtccaatctggatggccgatgagaagacctgggaaggggatgctgtccaaaccggccatgtggacatcaagcgcctgtcccgcacaatcaacccgtccaaggttcgtcggatggaccccttgggaatcatctccagcgcggtggtgactgatctgtatgcccgacacgggaagctgagccgcaaggatgccgaaagcacgggaatcatcttcgcaaccggctacggtcctgtgacggcggtgacgcagttcaatgacgggatcatccgccacggttccgagggtgccaacgccctggtgttcccgaacaccgtggtcaacgcagccgcaggccacctcgcgatgctgaatcgctaccgtggttacacggccaccttggcatgcggtggaaccagttcactcatggcgctgcttctcgctgctcgcgtcgttggccgcggcgctgcggatcgcatcatggtcgttatcgctgacgagtttcccagcattgccgtccaggccgtcgcaaagcttcctggctaccgacacagggttgatggttccggagccgtgctctcggaaggcgcggtatgcgtcctggtggaggccgtcgaagtcgccgaagcacgcggtaccgcccccatggcgctgctacgcggcttcggatcccgtggagagtccgtgggagtcggtcacaccgcatccgatggacgggcttgggccaaggccatggccgctgcactgggccaggccggcctgactgcctccgacgtgtcgaccgtcgtggcggcatcaagcggacatcctcgcgtcgaccgagccgagcaggcggccaggcggatcgtcggactgtccgcaaccgctacgaccttcccaaaggcgattgtcggagaaacacacggatcggctgccgggatcgggctgttcggtgccctgtgcggttcgaggtcagccgcgcaccagaacatccttgtcaacgccttttcccacggcggtggttatgcctcgatggtggtggagtcactgtgaccacgacgcttctgccacgggttgcccagccgggaccgggcgtcagccatgtcgacaccgaccgtcccatcgagtgcatcatcacccaccacccccacatgccgcgtgatcgcggaggccacgccacctccgtgtcaggcaggtacttgctgcgccaagccgcagaactcatgctcggcacggatcctgcgcattgccccgtcgtcgacccttcgcggcgctggtactggcccggaatcaatcttcacggttctgtctcccatgtcccgggctggagcctgacgacgctgagcaccggcggccacatcggggcagacatccaggacttccgggagcgtcccggcgcaatggcattcatcggtgacctggtcaagctgtcgcgatcggcgtcactccgagaattcgcggagtgcgaggccgtcgtcaaggtgtccgaattgactaaggagacgttcgggcacgtgcgactgcccgaatggacacccggatggcgccacgttttcgaggactactgggtctggagtctcgagatgcacgggatgggagtcatcgcactcgcatccgatctcccccgagccattcgctggtggcggtgcgacgccgatgcccgtggccgtctccaggctctccgacccataagcagtcttggaccaggaaggccgtcatgagccggtactcacgtcgaatctcaggcatcgaacgcggctatctcaacgccgcaacccggggcccgcaccccaccatccacacgatgatcgacttcgagggccgcgtccccgccgactgttggcggcacgcatccacgattgcgtcggccgccaaccctggcatgacagtggtccggaggtcgggccgatggacatccgatccagcgggctgtccggttgtgttccacgactggaccgcggaccccaacgacgttgccgacttccacgctgacatggatctcgtgacgggaccatcgtccacgctccacgttttcgagggggcggaacgcacccgaatcaccttggcagcaagccatgccgtgaccgatgggcggggcatcgaacgatttctcgtcgacctgcttgcagcgttggacgagcgtgaacccattggaagccccgacaccctgaccgatgtcgatatcaaacgatccttggagaacagcatcaagccccgacgccacctggccgctgtgcccgccgatgtcctttctccactgggggggaggaagaaccaacgtatatgggcctccaggacgtggcacagtgccccgggagccatgagcggaagaatcgctgccgctgtggccgagatgatcgaccacgccgcaatgatcatcatcccggttgacatccggcggcacgtcccagaggtccgatccacagcaaacctaagtgcccaactgccagtgatcatcaccccgaaccagcgctggcaaagcatccatgggcatctgctcacggaccttgctcgccatcgagaccttgcgatcatcagtgaggatttccgccacaacaatccgttcgcatcgaccttggaggaaagccaggccatcggcctcgatggtgtctatccctgtgccgcaatcatctccgaccacgggaagctcgacctttcaaggttccagaccttggaactcaccccggtctcgatgcgaagcctcccgatgctcgttccctactccgcaatgttcatcagcagttgcaccgtcggcgagaccaccactgtcaccatcgctcatcgcgctgatgacgatcccgattccataaacaccttcttccaccacatcgaatcccagatgtccatctgagccacgtcgtccctggagagcaaacatgaccacccaagatgtcatcaccccgccgcgccccgtcacctcccatgccacggcgaccaggtccgaggctccaccgcgaagcgtcatcagagccatggccatctcgatggtcgcgaccctcatggtcatgctcgacacgaccgtcgtgaacgtgtccttgagcgcgaccaccgcccgcttcgggagcatgggcagcgtgcagtgggtcctcacaagttacctacttgcactgtgcgcgacgatgacggcctccgcctgggtcatcgaccgccttggtccacggctcaccttcatcgcctcaatgaccatgttcctcatcggctcggtgatgtgtgcactgagcgattcagtgtggcaactcgtcactggcaggaccatctccggtgccggagctgggatccttgttccgacagcatccgtcctgcttatccgtggcatcccacgcgaacaacttggcagggtgcaggcactgaatgggagtgtccagttgatcgctcccctgatcggcccgactgtgggcggtctcctcgttgacaggtgcgggggctggccggccatctactgggcgaacgtccccgtagctcttgttcttctgattgaggccgtccgcgtcgatccggacgaaccacacaccgctaagcgccgcctcgatgctctcggcctggtctgtggcagcaccgcgatcgtgctgacagtgcttggtgtctcactcttcggcaggacgtcgcgaaacaccaccttcctgcttacgatcggcgcgcttgcagtcctcgcatgggcgttcttcatcacccacatccgaagggctaccaaccctctgcttgacgtttccctgtatcagaaccctgtctattcatggtccagcttcaacgtagcggtgcttggtttcggtctctacgcccccatggtcgtcatgcccctctatctcgaggcgacgcgccacctcactgccgtccacactggtctggtgatgtcagtggccggcgtcggcgtcattatggccggaatcctgtgcacgaagatcatgggccggatcggtggaggcctcacgatgacagttggcataactctgagcatcatcgccactctgcccctggtccggctgacgaaccacacctcctacatactcctggcagtctgcttggccttgcgtggagcaggaatcagcctgacaatcgtcccagccatgacacgggccttcgagtccatcaagaggacggccatggcggacgcctctgcacagctcaacctgttgcagcgaatcggcgggacaattgcgacagcagtcatcatcgcagttatccaccacgaggccatgctcacccgcggactctcccccacagtgttctcgcacgccaacgtgtggatcctcaccgcgaccgccgtcacccttctgccggccttcgcgcttgcgaaggccgaaagacaacagcaggatctctgagcaccgaggagtactccctcgtagaccctcctctgatctaattgggttcgttccaagtgtgtatctcactccggggagccccgattgctgaaccacatcccgttcaccctggcgagtccctcgtggtacgacgtcccctgggcgcccggatctccgtatctcacaggagatatctcggtcctgccagcggactcgccaaggtggacgacgaccatccggggtccttggcaaatccacatgccacctcgtccgacccttccagaggtggggtggaaagtgcatgtgtctgccaagccatcggaattggaatcggttgcctcagtcgtagcactgtggtgcgtacgccacagcgtccccttcaaagtacttcgcacccgaggtctcgttcacgcgagtcaagtcaagtatgcggaccgaagtcagagcggcaaggtctgcacctgctaccccgacggcgagagccttgagcacttctgctccggtcttgccgagctgcttcagaacgtcgattcacctccggtgtccggcgagctgcgagtcggatcctcccctctgtggttgcgtcacgggagtttccgagaggcatgggcggtgtcatccacaggagtaccgttcccggtctacccgggaacaacacatcctgatcgtcgaggccccgcgcccgcagaatccgatcacgacacgccgtggatccggaggctccgtcggacgaatcgccccagcacggttcttcccatcgacgatgtcagactcctccaccaatcaaatgctggcggcgtgtatcaggcaacatggagagacggcacatcggtagtcgtcaaggaggcccggcacctgtccggacttgatgcggcgggtgtcgacgcccgagtgcggctgcgtcacgagtacgaggccctgagaagactggacccctatcgggccgctccccatcccattgatctcattgagaccgaggacggctcgttcctgatcatggaattccttgacggaatgacagtccaccaggagatgtcgaggttccatcctctgattggtaggcgacctcatcggctatcgatgaccgatttttcacgctggtgccgagaggtcgaagatcgcttgaggaatgtcacgagggtcatggccgggtgcggaatcgttcacggggatcttcatcccgcgaatctgatacatgtcggccatgaggttttggttactgactttgaatcctgctcaatcgacggggtcgccgtctcgtcagggatcgccgctccctggttccagtcggacgacacgattcccgatccggcgacgactgacgatctccacactcttctcgtggatccgacttgcggccccgcgcttgtcctccatccaaatcttcgcgcgctcatcagccaggccgcagtcgaggacatgatgggaaatccgactggtttaccacatgcctggaacctcgaggacgtgacaagcgaactcgccaaggggatccgggcatcagccactcccgcacgagccgaccgcctctttccctcagacccctacctgttcgggcatccaggttcagaattcggcctgatgcatggcgccgccggaatcatggctgctcttgccgtgactgggtacggtgttgacgcgaatcacgtgacctggatgaaggaccgcttggccacccgcccgaccctgctgccggggttggccaacggaatcgagggaattgccctgggtctctccctgtgcggtcagaacgacatggctgcatccctgctccaccagtccggaattctcacgatcacaacgaacggatcgactgacctcaccctcggtactggtatggcgggccgagcgtgcgcgctgcagtccctctcacaacgactgtcatcgaaatctctcgcccacgctgcatgtaccctctgggaacaactcgccgtggctgtgcggaacactgatgtggccttgccgaacggcctgttctccggttgggaggggatcgggctctccctgcttgcctctcccctgccggatcgtcatgatctcgcccgccactcactccgactggccctggccacgacaacgattgttgacggtgcgctcttctcaggcgagggacagatccgatggccatatctggggcgtggtcccgcggcatgtggcccgctcgccgccaggcttgatgatgaccagacggccaaggccgtggcacagacctgtcgttgtcccctgactgagtcatccggtctccacaatggccgcgcaggtctcctactcgtcctccgccagctcgtgggagaccaagacgacgccgttcgccgccacctcatgagactgtcgtggtcgatggaccgtcgcgaggaaggcacattgctgctgggtgatcatggcctgcgtttctcatccgatctcgcgacggggtcagccggcgccctcctcgccctgagcagggacccatggcggaacatgacacgaatgctcggaatatgcgatgacacctgtcatggcccactagtgacagtttgatctagcgccgatagttcacaactgaaagactccaaacatcgaggaaaacatgctgagccaaaacgccttggcaggcgtggctcgtttcaccacgatgaacaccaggagacagaatgtccgttgaggccatgcaatccatcgagatggacgaggaaaacagcgccagccagacagtttgcgcttgttacagcttcttctcgtggtcaggatgctgcgtagtctcccaagcggtggaagcatcttgatcgtgtgagacgccgtcgactaccctgtcccccgtggtacgcacacgccccgtcctggacagtcccggaagaccgctcatcgcctccggagtcgtcctggcggtcctgctcatcatcgcggtgatgacgatggtgcttcagcgcgaccccactctcacccccggacgccgcattctcggtatcgtcctgtccacggtccaggccgtcggattcatgtggctgcagacccgcatggttcgtcacggcaagggttcgcgcaacatgcgtgcgacccttggaagggtcggtttctgggccacgtggggactcgtcgcagtgggagtcgtcaatctgtggctgaccaactcgtggaccctcttcggggcctccgtcgccacgcccctccttctcctgccaggggtgtggagtgtggtggccaccctcgtgaccctgatcgtcggtttctccgacctcgtggtcacccacacctcgccactgacctcagccacggtcgtgctggtgaccatcgcggtgtcggtgaacctctacgcattcacgaagctgtcgacggcactcgttgaactccgctcctcccaggaggagatcgcccggctgcgcgtggacgccgagcgtcaccggatatcgcgggacctccacgacatcatcggtcgcaccctggtcgccacgtcgatgcgccagcaggcggccctccacctcgtcgaccgcgacccgcaacgggccaaggaacagctcgacgccgcccatgacgcaatcaccgaggggcagcaccagttgcgttccatcatccaggccgagatgagcaccagcctccccgacgagatcagcgacgccacattcctgtgcgaccgactccacatcgacttccgcatggatgaccgcggcagaccgcacaaacccttcgactcggcggcggcggcggccctgcgcgagggaatcacgaacatgctcaagcacagcgcggcgggctactgccacgtcgccatctccccggacctcctgaccgtcaccaacgacggttgtccgcaatcacctcgcccctccaccacaccgggcaccggaatcgaccatctccggtcccagatcgaggcgctcggtgggtcggtgacgacgtcgcggccctcgcggggcaccttccggctccgctgctccttcccgacccggggggcgtccacgaccacacccgcgaccgaaggaggacgatgacgacgagaatcctcctcgccgaggacatcaaactggtggcagaggccttcgaggcactgctctcggtggaaccggagttcgaggtcgtcgcacgggtggcacgcggcgacgacctggtcacatccgccacccgcctgttccccgacgtgatcctggccgacatcgacatgcccgggatgaccggcatcgaggccacccgaatgcttcgcgacaagggataccgcggcagaatcatcctgctcaccgccctgccgggaagcgggcacctgcacgccgcgatggctgccggagccgacgggtacctgctcaagtcgatcaccgcgccctccctcatcaacgccatccgggcggtgtgcaacggccagtcggccatcgacccgaacgtcgccgcggtcgccatgcgcaagggaccctcgcccctcaacgaccgggaaaccgagattctgcgcctagtcgccgacggttcctccaccgcgcagatcgcctcgcggctgtacctcagcaagggcaccgtcaggaactacctgtcgacggcgatgtcgaagctcgacgccgactcacgcacagcggcggtcacgcgggcacgcgaggagggctggctgtagcaggcgacccgctcagcccaccgcccctcagcccaccgcccctcagcccgccgactcctgacgcacggcctcctcgaccgcccagctgagcagggacccggccctgaccatcgacgtctccgggtccggctcgaggtcggacaacgcgatgatccggtcgaacgcggaccgtttctcctcgggcaggtcacagcgtccgcacaccgcccagacgggcaccccggcgtcccgggcgatcttgcggatggtgtcgagaagcttgccgagcagggtctgctggtccagccgcccctcccccgtgacgacgagactggaggcggagatccgcgacaccgcgcgggaccatcccaggacgaccgccgcgcccgggcggtacctggtccccaggcacatcagcgcccagccgacccggctgggcggctgcgaaccccctggccaccgcccggcaggcctttcccgaactcagcgaccccttgaaggagtcgacggcaacgatgaccggcgcattcggatcaggacgcatgggatcagcatgtcacgtcgatacggagcagtcgcgccgcctacccctagactcgggggcatggtcaaccgagtctacctgtccctgagcgttctcgccctcgtgctgtgggtggtcgcctaccgtcacatgccgggctgggccgcgggcatcaccctggtgggcatcgtcgtgctgtcgctgtggtgcgagtggtcgcgggtgcgcaccctggccaggatcggcaagtcccgccagcagggcccccgctcctcccgaggacgcaacctgtcgtgagcaatacgattcccgcagccctccaccccggccctgacgaggcc

What is claimed is:

1. A pharmaceutical composition comprising:
   a) a therapeutically effective amount of a health-associated *Propionibacterium acnes* microbe, wherein the health-associated *Propionibacterium acnes* microbe is characterized by the following:
      i) it comprises at least one gene encoding a deoxyribose operon repressor and a gene encoding a type II lipase, and does not comprise a pIMPLE plasmid;
      ii) it comprises at least one gene encoding an ATP binding cassette transporter; and
      iii) it lacks a gene encoding a DNA binding response regulator and a gene encoding a phosphoglycerate kinase, and
   b) a pharmaceutically acceptable excipient or biological stabilizer.

2. The pharmaceutical composition of claim 1, wherein the health-associated *Propionibacterium acnes* microbe has been engineered or selected to comprise a deoxyribose operon repressor and a type II lipase.

3. The pharmaceutical composition of claim 1, wherein the health-associated *Propionibacterium acnes* microbe is an RT1 or RT2 ribotype.

4. The pharmaceutical composition of claim 1, wherein the health-associated *Propionibacterium acnes* microbe is not an RT6 ribotype.

5. The pharmaceutical composition of claim 1, wherein the health-associated *Propionibacterium acnes* microbe is an HP3A11 strain, an HP3B4 strain, an HP4G1 strain, or an HP5G4 strain.

6. The pharmaceutical composition of claim 1, comprising an additional strain of bacteria, wherein the additional strain is *Propionibacterium avidum*, *Propionibacterium acnes* subsp. *defendens*, or *Propionibacterium granulosum*.

7. A method of treating a skin disorder or condition in a subject in need thereof comprising applying a therapeutically effective amount of the pharmaceutical composition of claim 1 to the skin affected by the disorder or condition.

8. The method of claim 7, wherein the skin disorder or condition comprises acne, eczema, seborrheic dermatitis, psoriasis, or rosacea, or a combination thereof.

9. The method of claim 7, wherein the health-associated *Propionibacterium acnes* microbe has been engineered or selected to express the gene encoding the deoxyribose operon repressor and the gene encoding the type II lipase.

10. The method of claim 7, wherein the health-associated *Propionibacterium acnes* microbe is an RT1 or RT2 ribotype.

11. The method of claim 7, wherein the health-associated *Propionibacterium acnes* microbe is not an RT6 ribotype.

12. The method of claim 7, wherein the health-associated *Propionibacterium acnes* microbe is a mixture of two or more different ribotypes.

13. The method of claim 7, wherein the health-associated *Propionibacterium acnes* microbe is an HP3A11 strain, an HP3B4 strain, an HP4G1 strain, or an HP5G4 strain.

14. The method of claim 7, wherein the pharmaceutical composition comprises an additional strain of bacteria, wherein the additional strain is *Propionibacterium avidum*, *Propionibacterium acnes* subsp. *defendens*, or *Propionibacterium granulosum*.

15. A pharmaceutical composition comprising:
   a) a first therapeutically effective amount of a first health-associated *Propionibacterium acnes* microbe, wherein the first health-associated *Propionibacterium acnes* microbe is characterized by the following:
      i) it comprises at least one gene encoding a deoxyribose operon repressor and a gene encoding a type II lipase, and does not comprise a pIMPLE plasmid;
      ii) it comprises at least one gene encoding an ATP binding cassette transporter; and
      iii) it lacks a gene encoding a DNA binding response regulator and a gene encoding a phosphoglycerate kinase;
   b) a second therapeutically effective amount of a second health-associated microbe; and
   c) a pharmaceutically acceptable excipient or biological stabilizer.

16. The pharmaceutical composition of claim 15, wherein the second health-associated microbe is a strain of bacteria that is *P. acnes, P. granulosum, P. acnes* subsp. *defendens* or *P. avidum*.

17. The pharmaceutical composition of claim 15, wherein the second health-associated microbe is characterized by at least one of the following:
   a) it comprises at least one gene encoding at least one of a deoxyribose operon repressor and a type II lipase;
   b) it comprises at least one gene encoding an ATP binding cassette transporter;
   c) it lacks a gene encoding a DNA binding response regulator or a phospho-glycerate kinase; and
   d) it lacks the pIMPLE plasmid.

18. The pharmaceutical composition of claim 15, wherein the first health-associated *Propionibacterium acnes* microbe or the second health-associated microbe is an isolated or purified strain of bacteria.

* * * * *